US010428313B2

(12) United States Patent
Kinney

(10) Patent No.: US 10,428,313 B2
(45) Date of Patent: Oct. 1, 2019

(54) CHIMERIC WEST NILE/DENGUE VIRUSES AND METHODS OF USE

(71) Applicant: The United States of America, as represented by the Secretary, Dept. of Health and Human Services, Bethesda, MD (US)

(72) Inventor: Claire Y. H. Kinney, Fort Collins, CO (US)

(73) Assignee: The United States of America, as represented by the Secretary, Department of Health and Human Services, Bethesda, MD (US)

( * ) Notice: Subject to any disclaimer, the term of this patent is extended or adjusted under 35 U.S.C. 154(b) by 95 days.

(21) Appl. No.: 15/318,334

(22) PCT Filed: Jun. 19, 2015

(86) PCT No.: PCT/US2015/036728
§ 371 (c)(1),
(2) Date: Dec. 12, 2016

(87) PCT Pub. No.: WO2015/196094
PCT Pub. Date: Dec. 23, 2015

(65) Prior Publication Data
US 2017/0114330 A1 Apr. 27, 2017

Related U.S. Application Data

(60) Provisional application No. 62/015,265, filed on Jun. 20, 2014.

(51) Int. Cl.
*C12N 7/00* (2006.01)
*A61K 39/12* (2006.01)
*C07K 14/005* (2006.01)
*A61K 39/00* (2006.01)

(52) U.S. Cl.
CPC ............... *C12N 7/00* (2013.01); *A61K 39/12* (2013.01); *C07K 14/005* (2013.01); *A61K 2039/5252* (2013.01); *A61K 2039/5256* (2013.01); *A61K 2039/70* (2013.01); *C07K 2319/00* (2013.01); *C12N 2770/24122* (2013.01); *C12N 2770/24134* (2013.01); *C12N 2770/24162* (2013.01); *Y02A 50/386* (2018.01); *Y02A 50/394* (2018.01)

(58) Field of Classification Search
None
See application file for complete search history.

(56) References Cited

U.S. PATENT DOCUMENTS 8,715,689 B2 * 5/2014 Kinney .................. A61K 39/12
424/202.1
2006/0062803 A1 3/2006 Kinney

FOREIGN PATENT DOCUMENTS

| CN | 102202687 A | 9/2011 |
|---|---|---|
| CN | 1551782 A | 12/2014 |
| WO | WO 2009/134717 A1 | 11/2009 |

OTHER PUBLICATIONS

Suzuki et al. J of Virology 2009 vol. 83 pp. 1870-1880.*
Amanna et al., "Development of a new hydrogen peroxide-based vaccine platform," *Nat. Med.*, vol. 18, No. 6, pp. 974-979, 2012 (14 pages, author manuscript version).
Hanson et al., "Photochemical Inactivation of DNA and RNA Viruses by Psoralen Derivatives," *J. Gen. Virol.*, vol. 40, pp. 345-358, 1978.
Pinto et al., "A Hydrogen Peroxide-Inactivated Virus Vaccine Elicits Humoral and Cellular Immunity and Protects against Lethal West Nile Virus Infection in Aged Mice," *J. Virol.*, vol. 87, No. 4, pp. 1926-1936, 2013.
Raviv et al., "Hydrophobic Inactivation of Influenza Viruses Confers Preservation of Viral Structure with Enhanced Immunogenicity," *J. Virol.*, vol. 82, No. 9, pp. 4612-4619, 2008.
Raviprakash et al., "Dengue virus photo-inactivated in presence of 1,5-iodonaphthylazide (INA) or AMT, a psoralen compound (4'-aminomethyl-trioxsalen) is highly immunogenic in mice," *Human Vaccines Immunother.*, vol. 9, No. 11, pp. 2336-2341, 2013.
Suzuki et al., "Construction and Characterization of a Single-Cycle Chimeric Flavivirus Vaccine Candidate That Protects Mice against Lethal Challenge with Dengue Virus Type 2," *Journal of Virology*, vol. 83, No. 4, pp. 1870-1880, 2009.
Yu, "Progress of Arbo-Flavivirus Chimeric Vaccines," *Virologica Sinica*, vol. 19, No. 4, pp. 413-417, 2004 (No Abstract available).

* cited by examiner

*Primary Examiner* — Shanon A. Foley
*Assistant Examiner* — Myron G Hill
(74) *Attorney, Agent, or Firm* — Klarquist Sparkman, LLP

(57) ABSTRACT

Disclosed herein are chimeric *flaviviruses* including non-coding regions, non-structural proteins, and at least a portion of a C protein from West Nile virus (WNV), and a prM protein and an E protein from Dengue virus (DENV). The DENV may be DEN1 serotype, DEN2 serotype, DEN3 serotype, or DEN4 serotype. Also disclosed herein are compositions and methods for eliciting an immune response in a subject, such as an immune response to one or more DENV serotypes. In particular embodiments, the compositions include one or more inactivated viruses including a WN/DENV chimeric nucleic acid (such as a tetravalent inactivated vaccine including a WN/DEN1 chimera, a WN/DEN2 chimera, a WN/DEN3 chimera, and a WN/DEN4 chimera). The compositions may be administered to a subject to elicit an immune response.

29 Claims, 4 Drawing Sheets

Specification includes a Sequence Listing.

FIG. 2A

Growth in Vero cells- day 2 pi

(Bar chart: $\log_{10}$ pfu/ml vs. WNV, WN/DENV-1, DENV-1, WN/DENV-2, DENV-2, WN/DENV-3, DENV-3, WN/DENV-4, DENV-4)

FIG. 2B

Growth in C6/36 cells- day 4 and 6 pi

(Bar chart: $\log_{10}$ pfu/ml vs. WNV, WN/DENV-1, DENV-1, WN/DENV-2, DENV-2, WN/DENV-3, DENV-3, WN/DENV-4, DENV-4; day 4 and day 6)

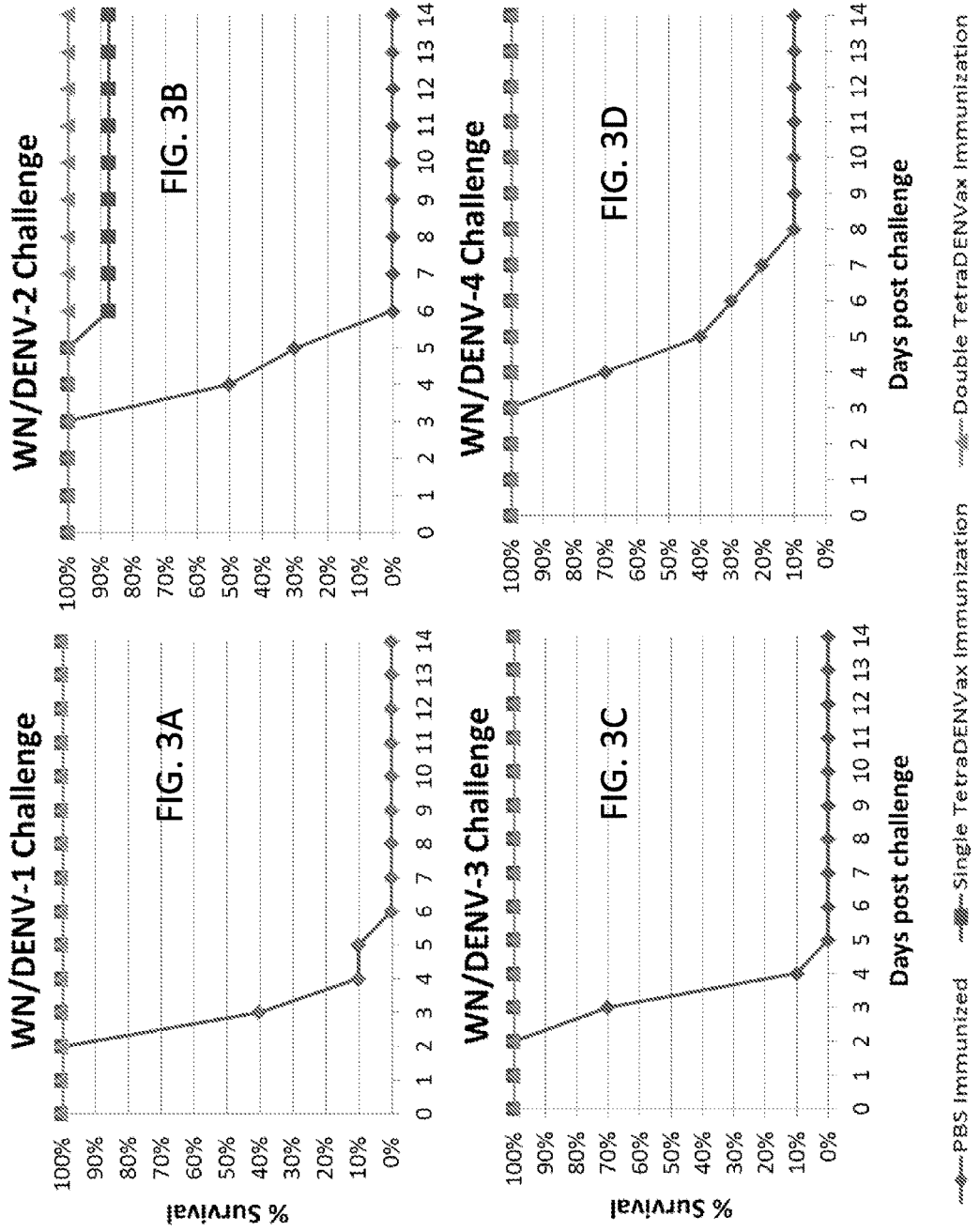

FIG. 4

| Visible Plaques (day pi) | |
|---|---|
| WNV | 3 |
| WN/DENV-1 | 3 |
| WN/DENV-2 | 3 |
| WN/DENV-3 | 3 |
| WN/DENV-4 | 3 |
| DENV-1 | 6 |
| DENV-2 | 7 |
| DENV-3 | 6 |
| DENV-4 | 6 |

Plaques on day 3 post infection of Vero cells

WN/DENV-1  WN/DENV-2  WN/DENV-3  WN/DENV-4

WNV NY99  DENV-1 16007*

* Plaques of all 4 parental wt DENVs are not visible on day 3 pi. DENV-1 16007 was shown as an example.

FIG. 5A 48 hrs wtDENV1  wtDENV2  wtDENV3  wtDENV4

24 hrs

WN/DENV1  WN/DENV2  WN/DENV3  WN/DENV4

FIG. 5B

CHIMERIC WEST NILE/DENGUE VIRUSES AND METHODS OF USE

CROSS REFERENCE TO RELATED APPLICATION

This is the § 371 U.S. National Stage of International Application No. PCT/US2015/036728, filed Jun. 19, 2015, which was published in English under PCT Article 21(2), which in turn claims the benefit of U.S. Provisional Application No. 62/015,265, filed Jun. 20, 2014, which is incorporated herein by reference in its entirety.

FIELD

The disclosure relates to chimeric *flaviviruses*, particularly chimeric West Nile virus/Dengue virus constructs. Further, it relates to methods of using these chimeras in methods to elicit an immune response in a subject.

BACKGROUND

Dengue virus (DENV) is the most important arboviral cause of morbidity and mortality throughout the world. There are currently 2.5 billion people living in dengue endemic regions with roughly 100 million annual cases of dengue fever and hundreds of thousands of cases of dengue hemorrhagic fever and dengue shock syndrome (Gubler, *Clin. Microbiol. Rev.* 11:480-496, 1998). No vaccines are currently commercially available against any of the four DENV serotypes (DENV 1-4), though several vaccines are currently in development or clinical trials. DENV vaccine production is hampered by the fact that neutralizing antibodies to one serotype do not effectively neutralize the remaining DENV serotypes (Halstead and O'Rourke, *J. Exp. Med.* 146:201-217, 1977). In fact, low levels of these antibodies may actually increase the risk for more severe disease during secondary infection due to a phenomenon known as antibody-mediated enhancement, which occurs when antibodies against one DENV serotype bind in a non-neutralizing manner to DENV particles of another serotype. This binding allows increased infection of Fc receptor-bearing cells, such as macrophages, which can change the infection profile of the virus or cause a release of chemokines leading to dengue hemorrhagic fever or dengue shock syndrome (Halstead and O'Rourke, *J. Exp. Med.* 146:201-217, 1977).

SUMMARY

Disclosed herein are chimeric *flaviviruses* including non-coding regions, non-structural proteins, and at least a portion of a C protein from WNV, and a prM protein and an E protein from DENV. The DENV may be DEN1 serotype, DEN2 serotype, DEN3 serotype, or DEN4 serotype. In some examples, the prM and E proteins are from different DENVs (for example, from different DENV serotypes).

In some embodiments, the chimera includes a first nucleic acid molecule including a 5' non-coding region, a nucleic acid encoding a C protein and non-structural proteins, and a 3' non-coding region from a West Nile virus and a second nucleic acid molecule operably linked to the first nucleic acid molecule, encoding at least a portion of a prM protein and E protein from a DENV.

In additional embodiments, the chimera includes a first nucleic acid molecule including a 5' non-coding region, a nucleic acid encoding a portion of a C protein and non-structural proteins, and a 3' non-coding region from a West Nile virus and a second nucleic acid molecule operably linked to the first nucleic acid molecule, encoding at least a portion of a C protein, a prM protein, and an E protein from a DENV. In some examples, the portion of the WNV C protein encoding the prM signal sequence is replaced with the signal sequence from the DENV. In other examples, the prM signal sequence includes a 5' portion of the WNV signal sequence and 3' portion of the DENV signal sequence.

In some examples, the chimeric *flavivirus* includes at least one nucleic acid or amino acid substitution which improves chimera characteristics (such as increased replication in cell culture, decreased infectivity or transmissibility in mosquitoes, or reduced antibody cross-reactivity). In particular examples, the amino acid substitution is in the WNV or DEN C protein, the DENV prM protein, the DENV E protein, or a WNV NS protein.

Also disclosed herein are compositions and methods for eliciting an immune response in a subject, such as an immune response to one or more DENV serotypes. In particular embodiments, the compositions include one or more inactivated viruses including a WN/DENV chimeric nucleic acid (such as a tetravalent inactivated vaccine including a WN/DEN1 chimera, a WN/DEN2 chimera, a WN/DEN3 chimera, and a WN/DEN4 chimera). The compositions are administered to a subject to elicit an immune response, such as a protective immune response. Methods of inactivating the WN/DEN chimeras are also disclosed herein.

The foregoing and other features of the disclosure will become more apparent from the following detailed description, which proceeds with reference to the accompanying figures.

BRIEF DESCRIPTION OF THE DRAWINGS

FIG. 1A shows a wild type WNV, which includes a 5' noncoding region (NCR), a capsid (C) protein including the signal sequence (C(ss)) for the prM protein, a premembrane (prM) protein, an envelope (E) protein, non-structural (NS) proteins 1-5, and a 3' NCR. FIG. 1B shows a chimeric WN/DENV with a Type I junction, including the 5' NCR, C protein, NS proteins 1-5, and 3' NCR from WNV (open boxes), and C(ss), prM protein, and E protein from a DENV (shaded boxes). FIG. 1C shows a chimeric WN/DENV with a Type II junction, including the 5' NCR, C protein, NS proteins 1-5, and 3' NCR from WNV (open boxes), and prM protein and E protein from a DENV (shaded boxes). This virus includes a 5' portion of C(ss) from WNV and a 3' portion of C(ss) from a DENV. FIG. 1D shows a chimeric WN/DENV with a Type III junction, including the 5' NCR, C protein and C(ss), NS proteins 1-5, and 3' NCR from WNV (open boxes), and prM protein and E protein from a DENV (shaded boxes).

FIGS. 2A and 2B are graphs showing growth of WN/DENV chimeras and the corresponding DEN viruses in Vero cells at day 2 post-infection (p.i.) (FIG. 2A) or in C6/36 cells at days 4 (left bars) and 6 (right bars) p.i. (FIG. 2B).

FIGS. 3A-3D are a series of graphs showing survival curves of AG129 mice vaccinated with a tetravalent DENV candidate vaccine and challenged with the WN/DENV-1 chimera (FIG. 3A), WN/DENV-2 E203 chimera (FIG. 3B), WN/DENV-3 CE345 chimera (FIG. 3C), or WN/DENV-4 C107 chimera (FIG. 3D).

FIG. 4 shows the timing of visible plaques produced by WNV, WN/DENV chimeras, and DENV1-4 (left) and a digital image of plaques in 6-well plates at day 3 p.i. on Vero cells (right).

FIGS. 5A and 5B are a series of images showing immunostained micro-foci from DENV1-4 48 hours p.i. (FIG. 5A) and WN/DENV chimeras 24 hours p.i. (FIG. 5B) in 96-well Vero cell plates. Foci were quantitated using automated counting parameters optimized for each serotype on an iSpot Reader Spectrum (Autoimmun Diagnostika, GMBH).

SEQUENCE LISTING

Figure 1A:
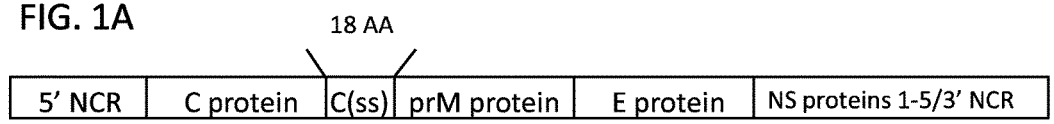
FIGS. 1A-1D are a series of schematic drawings showing the genomic organization of wild type or chimeric viruses described herein. The genome structure is not shown to scale.

Any nucleic acid and amino acid sequences listed herein or in the accompanying Sequence Listing are shown using standard letter abbreviations for nucleotide bases and amino acids, as defined in 37 C.F.R. § 1.822. In at least some cases, only one strand of each nucleic acid sequence is shown, but the complementary strand is understood as included by any reference to the displayed strand.

The Sequence Listing is submitted as an ASCII text file in the form of the file named Sequence_Listing.txt, which was created on Dec. 12, 2016, and is 828,415 bytes, which is incorporated by reference herein.

SEQ ID NOs: 1 and 2 are WNV clone IC-P991 nucleic acid and amino acid sequences, respectively.

SEQ ID NOs: 3 and 4 are DEN1 16007 nucleic acid and amino acid sequences, respectively.

SEQ ID NOs: 5 and 6 are DEN2 16681 nucleic acid and amino acid sequences, respectively.

SEQ ID NOs: 7 and 8 are DEN3 16562 nucleic acid and amino acid sequences, respectively.

SEQ ID NOs: 9 and 10 are DEN4 1036 nucleic acid and amino acid sequences, respectively.

SEQ ID NOs: 11 and 12 are WN/DEN1 type I junction chimera nucleic acid and amino acid sequences, respectively.

SEQ ID NOs: 13 and 14 are WN/DEN2 E203-Asp type I chimera nucleic acid and amino acid sequences, respectively.

SEQ ID NOs: 15 and 16 are WN/DEN3 E345-Leu type II junction (BE3345) chimera nucleic acid and amino acid sequences, respectively.

SEQ ID NOs: 17 and 18 are WN/DEN3 E345-Leu type III junction (CE345) chimera nucleic acid and amino acid sequences, respectively.

SEQ ID NOs: 19 and 20 are WN/DEN4 C107-Pro type I junction chimera nucleic acid and amino acid sequences, respectively.

SEQ ID NOs: 21-23 are amino acid sequences of exemplary type II junctions for WN/DEN1, WN/DEN2, and WN/DEN4 chimeras, respectively.

DETAILED DESCRIPTION

Although both DENV and WNV are *flaviviruses*, DENV replicates much more slowly and to lower titers than WNV in cell cultures. This makes production of DEN viruses or viral antigens (for example for development of DENV vaccines) more difficult than for WNV. The chimeric WN/DEN viruses described herein contain DENV antigenic structures on the surface of the virus particles while retaining certain WNV features (such as replication to high titer). The disclosed chimeras can thus be used in development of immunogenic compositions, such as inactivated virus vaccines, for eliciting an immune response to DEN viruses. Due to their fast and more robust growth than the wt DENVs in cell cultures, these chimeras can be produced in large quantity more efficiently than the wild-type DENVs for making inactivated virus.

In addition, in DENV vaccination protocols, it is important to achieve balanced immunity against all four DENV serotypes to minimize the potential risk of severe disease outcomes associated with antibody enhancement of DENV infection. Therefore, the inactivated WN/DENV chimeras and immunogenic compositions containing them may be a better choice for people who have acquired previous DENV infection but do not have immunity to all four DENVs. It has been shown to be difficult to achieve balanced immunity using a tetravalent live attenuated recombinant DENV vaccine (see, U.S. Pat. No. 7,094,411) after single or multiple doses, due to interference among the viruses during replication. An inactivated vaccine (alone, or as a booster) could potentially resolve this issue, since there will be no virus interference (no replication required).

The chimeric WN/DEN viruses disclosed herein may also be virulent and/or generate high viremia in mice, therefore they can be used as a challenge dose to assess the efficacy of DENV candidate vaccines. They can also be used as a DEN-like surrogate virus for testing DENV candidate vaccine efficacy and for faster and/or more effective DENV diagnostics.

I. Abbreviations

C capsid protein
C(ss) prM signal sequence portion of C protein
DEN or DENV Dengue virus
E envelope glycoprotein
ELISA enzyme-linked immunosorbent assay
mAb monoclonal antibody
mFRNT microfocus reduction neutralization test
NCR non-coding region
pfu plaque forming unit
P.i. post-infection
prM premembrane protein
PRNT plaque reduction neutralization test
$LD_{50}$ 50% lethal dose
WN or WNV West Nile virus
WN/DEN West Nile/Dengue virus chimera II. Terms Unless otherwise noted, technical terms are used according to conventional usage. Definitions of common terms in molecular biology may be found in Lewin's Genes X, ed. Krebs et al, Jones and Bartlett Publishers, 2009 (ISBN 0763766321); Kendrew et al. (eds.), *The Encyclopedia of Molecular Biology*, published by Blackwell Publishers, 1994 (ISBN 0632021829); Robert A. Meyers (ed.), *Molecular Biology and Biotechnology: a Comprehensive Desk Reference*, published by Wiley, John & Sons, Inc., 1995 (ISBN 0471186341); and George P. Rédei, *Encyclopedic Dictionary of Genetics, Genomics, Proteomics and Informatics*, 3rd Edition, Springer, 2008 (ISBN: 1402067534).

Unless otherwise explained, all technical and scientific terms used herein have the same meaning as commonly understood by one of ordinary skill in the art to which this disclosure belongs. The singular terms "a," "an," and "the" include plural referents unless context clearly indicates otherwise. Similarly, the word "or" is intended to include "and" unless the context clearly indicates otherwise. It is further to be understood that all base sizes (lengths) or amino acid sizes (lengths), and all molecular weight or molecular mass values, given for nucleic acids or polypeptides are approximate, and are provided for description. All publications, patent applications, patents, and other references mentioned herein are incorporated by reference in their entirety for all purposes. All GenBank Accession Nos. mentioned herein are incorporated by reference in their entirety. Although methods and materials similar or equivalent to those described herein can be used in the practice or testing of the present disclosure, suitable methods and materials are described below. In case of conflict, the present specification, including explanations of terms, will control. In addition, the materials, methods, and examples are illustrative only and not intended to be limiting.

In order to facilitate review of the various embodiments of the invention, the following explanations of specific terms are provided:

Antibody: A protein (or protein complex) that includes one or more polypeptides substantially encoded by immunoglobulin genes or fragments of immunoglobulin genes. The recognized immunoglobulin genes include the kappa, lambda, alpha, gamma, delta, epsilon, and mu constant region genes, as well as the myriad of immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively.

The basic immunoglobulin (antibody) structural unit is generally a tetramer. Each tetramer is composed of two identical pairs of polypeptide chains, each pair having one "light" (about 25 kDa) and one "heavy" (about 50-70 kDa) chain. The N-terminus of each chain defines a variable region of about 100 to 110 or more amino acids primarily responsible for antigen recognition. The terms "variable light chain" ($V_L$) and "variable heavy chain" ($V_H$) refer, respectively, to these light and heavy chains.

As used herein, the term "antibodies" includes intact immunoglobulins as well as a number of well-characterized fragments. For instance, Fabs, Fvs, and single-chain Fvs (scFvs) that bind to target protein (or epitope within a protein or fusion protein) would also be specific binding agents for that protein (or epitope). These antibody fragments are defined as follows: (1) Fab, the fragment which contains a monovalent antigen-binding fragment of an antibody molecule produced by digestion of whole antibody with the enzyme papain to yield an intact light chain and a portion of one heavy chain; (2) Fab', the fragment of an antibody molecule obtained by treating whole antibody with pepsin, followed by reduction, to yield an intact light chain and a portion of the heavy chain; two Fab' fragments are obtained per antibody molecule; (3) (Fab')$_2$, the fragment of the antibody obtained by treating whole antibody with the enzyme pepsin without subsequent reduction; (4) F(ab')$_2$, a dimer of two Fab' fragments held together by two disulfide bonds; (5) Fv, a genetically engineered fragment containing the variable region of the light chain and the variable region of the heavy chain expressed as two chains; and (6) single chain antibody, a genetically engineered molecule containing the variable region of the light chain, the variable region of the heavy chain, linked by a suitable polypeptide linker as a genetically fused single chain molecule. Methods of making these fragments are routine (see, for example, Harlow and Lane, *Using Antibodies: A Laboratory Manual*, CSHL, New York, 1999).

Antibodies for use in the methods and devices of this disclosure can be monoclonal or polyclonal. Merely by way of example, monoclonal antibodies can be prepared from murine hybridomas according to the classical method of Kohler and Milstein (*Nature* 256:495-97, 1975) or derivative methods thereof. Detailed procedures for monoclonal antibody production are described in Harlow and Lane, *Using Antibodies: A Laboratory Manual*, CSHL, New York, 1999.

Antibody binding affinity: The strength of binding between a single antibody binding site and a ligand (e.g., an antigen or epitope). The affinity of an antibody binding site X for a ligand Y is represented by the dissociation constant ($K_d$), which is the concentration of Y that is required to occupy half of the binding sites of X present in a solution. A smaller $K_d$ indicates a stronger or higher-affinity interaction between X and Y and a lower concentration of ligand is needed to occupy the sites. In general, antibody binding affinity can be affected by the alteration, modification and/or substitution of one or more amino acids in the epitope recognized by the antibody paratope. In one example, antibody binding affinity is measured by end-point titration in an Ag-ELISA assay.

Antigen: A compound, composition, or substance that can stimulate the production of antibodies or a T-cell response in an animal, including compositions that are injected or absorbed into an animal. An antigen reacts with the products of specific humoral or cellular immunity, including those induced by heterologous immunogens. In one embodiment, an antigen is a virus antigen, such as a *flavivirus* E protein.

Capsid protein (C protein): A *flavivirus* structural protein that functions to package viral RNA into the nucleocapsid core during virus assembly. The C-terminal portion of the C protein includes an internal signal sequence (referred to herein as C(ss), in some examples) for translocation of the prM protein into the endoplasmic reticulum, where cleavage of the C and prM proteins occurs. This signal sequence varies in length among different *flaviviruses*. For example, the C(ss) of DEN viruses is 14 amino acids, while the C(ss) of WNV is 18 amino acids.

Chimera: A molecule (e.g., nucleic acid or protein) composed of parts that are of different origin (such as at least two nucleic acids or polypeptides) that, while typically unjoined in their native state, are joined or linked to form a single continuous molecule. A chimera may include nucleic acids or polypeptides that are joined end-to-end (for example, the amino-terminus of one sequence is joined to the carboxyl-terminus of a second sequence) or may include a sequence from one molecule that is embedded within that of another molecule (for example, the amino-terminus and carboxyl-terminus of the chimera are from one molecule, while an intervening sequence comes from another molecule).

A chimera may include a chimeric protein, for example a protein that is composed of amino acids from more than one protein. A chimera may also include a chimeric nucleic acid composed of nucleic acid sequences from more than one source, such as a chimeric nucleic acid which encodes a chimeric protein. In other examples, a chimera may include a chimeric genome, such as a *flavivirus* genome, which is composed of sequences from two or more *flaviviruses*. For example, a chimeric *flavivirus* genome may comprise nucleic acid sequences from more than one *flavivirus* genome, such as a West Nile virus and a Dengue virus. In some examples, a chimeric *flavivirus* includes nucleic acids encoding one or more proteins from a first *flavivirus* and nucleic acids encoding one or more proteins from a second *flavivirus*. In particular examples, a chimeric *flavivirus* is composed of a nucleic acid encoding the non-structural proteins and a C protein or a portion thereof from a West Nile virus genome linked to a nucleic acid encoding at least a portion of a prM protein and E protein (and optionally a portion of a C protein) from a Dengue virus genome (such as DEN1, DEN2, DEN3, or DEN4). Exemplary chimeric *flaviviruses* are shown schematically in FIGS. 1A-1D.

Conservative substitution: A substitution of one amino acid residue in a protein sequence for a different amino acid residue having similar biochemical properties. Typically, conservative substitutions have little to no impact on the activity of a resulting polypeptide. For example, ideally, a *flavivirus* protein (such as a prM, E, or non-structural protein) including one or more conservative substitutions (for example 1-10, 2-5, or 10-20, or no more than 2, 5, 10, 20, 30, 40, or 50 substitutions) retains the structure and function of the wild-type protein. A polypeptide can be produced to contain one or more conservative substitutions by manipulating the nucleotide sequence that encodes that polypeptide using, for example, standard procedures such as site-directed mutagenesis or PCR. In one example, such variants can be readily selected for additional testing by infecting cells with a virus containing a variant protein and determining its ability to replicate, by producing virus containing a variant protein and determining its neurovirulence or neuroinvasion properties, and/or by testing antibody cross-reactivity.

Envelope glycoprotein (E protein): A *flavivirus* structural protein that mediates binding of *flavivirus* virions to cellular receptors on host cells. The *flavivirus* E protein is required for membrane fusion, and is the primary antigen inducing protective immunity to *flavivirus* infection. *Flavivirus* E protein affects host range, tissue tropism and viral virulence. The *flavivirus* E protein contains three structural and functional domains, DI-DIII. In mature virus particles the E protein forms head to tail homodimers lying flat and forming a dense lattice on the viral surface.

*Flavivirus* cross-reactive antibody: An antibody that recognizes (that is, specifically binds to) an epitope found on a peptide from more than one species of *flavivirus*. *Flavivirus* cross-reactive antibodies are classified as either complex cross-reactive or group cross-reactive antibodies. Complex cross-reactive antibodies recognize epitopes shared by all viruses within a complex, such as the JE virus complex or the DENV complex. Group cross-reactive antibodies recognize epitopes shared by all members of the genus *Flavivirus*.

Antibody cross-reactivity is further refined within the sub-complex and sub-group cross-reactive categories. Sub-complex cross-reactive antibodies recognize epitopes shared by most, but not all, members of a particular *flavivirus* complex (e.g., DEN-1, -2, and -3, but not DEN-4), while sub-group cross-reactive antibodies recognize epitopes shared by *flaviviruses* from several complexes, but not all members of the *flavivirus* group (e.g., all members of the DENV and JE virus complexes, but not all members of the tick-borne virus complex).

*Flavivirus* non-structural protein: There are seven non-structural (NS) proteins of a *flavivirus*, NS1, NS2A, NS2B, NS3, NS4A, NS4B, and NS5, which are encoded by the portion of the *flavivirus* genome that is 3' to the structural proteins. NS1 has been implicated in RNA replication and has been shown to be secreted from infected mammalian cells (Post et al., *Virus Res.* 18:291-302, 1991; Mackenzie et al., *Virology* 220:232-240, 1996; Muylaert et al., *Virology* 222:159-168, 1996). NS1 can elicit strong humoral immune responses and is a potential vaccine candidate (Shlesinger et al., *J. Virol.* 60:1153-1155, 1986; Qu et al., *J. Gen. Virol.* 74:89-97, 1993). NS2 is cleaved into NS2A and NS2B. NS2A is involved in RNA replication and virus particle assembly and secretion and NS2B forms a complex with NS3 and functions as a cofactor for the NS3 protease, which cleaves portions of the virus polyprotein. NS3 also functions as an RNA helicase and is used to unwind viral RNA during replication (Li et al., *J. Virol.* 73:3108-3116, 1999). While the exact functions of NS4A and NS4B remain to be elucidated, they are thought to be involved in RNA replication and RNA trafficking (Lindenbach and Rice, In: *Fields Virology*, Knipe and Howley, eds., Lippincott, Williams, and Wilkins, 991-1041, 2001). Finally, the NS5 protein is an RNA-dependent RNA polymerase involved in genome replication (Rice et al., *Science* 229:726-733, 1985). NS5 also shows methyltransferase activity commonly found in RNA capping enzymes (Koonin, *J. Gen. Virol.* 74:733-740, 1993).

*Flavivirus* structural protein: The capsid (C), premembrane (prM), and envelope (E) proteins of a *flavivirus* are the viral structural proteins. *Flavivirus* genomes consist of positive-sense RNAs that are roughly 11 kb in length. The genome has a 5' cap, but lacks a 3' polyadenylated tail (Wengler et al., *Virology* 89:423-437, 1978) and is translated into one polyprotein. The structural proteins (C, PrM, and E) are at the amino-terminal end of the polyprotein followed by the non-structural proteins (NS1-5). The polyprotein is cleaved by virus and host derived proteases into individual proteins. The C protein forms the viral capsid while the prM and E proteins are embedded in the surrounding envelope (Russell et al., *The Togaviruses: Biology, Structure, and Replication*, Schlesinger, ed., Academic Press, 1980). The E protein functions in binding to host cell receptors resulting in receptor-mediated endocytosis. In the low pH of the endosome, the E protein undergoes a conformational change causing fusion between the viral envelope and the endosomal membranes. The prM protein is believed to stabilize the E protein until the virus exits the infected cell, at which time prM is cleaved to the mature M protein (Reviewed in Lindenbach and Rice, In: *Fields Virology*, Knipe and Howley, eds., Lippincott, Williams, and Wilkins, 991-1041, 2001).

Heterologous: Originating from a different genetic sources or species. For example, a chimeric nucleic acid including nucleic acid from two (or more) different genetic sources or from two (or more) otherwise separated segments of sequence from a single genetic source is considered a heterologous nucleic acid. Similarly, a polypeptide including peptides from two (or more) different proteins from a single genetic source or two (or more) proteins from different genetic sources (such as a fusion protein) is considered a heterologous polypeptide. For example, a nucleic acid comprising portions of a WNV genome operably linked to a nucleic acid comprising portions of a DENV genome is a heterologous nucleic acid. Similarly, a polypeptide including a WNV polypeptide or portion thereof linked to a DENV polypeptide or portion thereof is a heterologous polypeptide.

In another example of use of the term heterologous, a nucleic acid that is heterologous to a cell originates from an organism or species other than the cell in which it is expressed. In one specific, non-limiting example, a heterologous nucleic acid includes a *flavivirus* nucleic acid that is present or expressed in a bacterial cell (such as an *E. coli* cell) or in an algal, plant, insect (e.g. C6/36), or mammalian (e.g., Vero) cell. Methods for introducing a heterologous nucleic acid into bacterial, algal, plant, insect, and mammalian cells are well known in the art, including infection of a cell with a viral nucleic acid, or transformation with a nucleic acid, for example electroporation, lipofection, and particle gun acceleration.

Immune response: A response of a cell of the immune system, such as a B-cell, T-cell, macrophage or polymorphonucleocyte, to a stimulus such as an antigen. An immune response can include any cell of the body involved in a host defense response for example, an epithelial cell that secretes an interferon or a cytokine. An immune response includes, but is not limited to, an innate immune response or inflammation.

Inactivated virus: A virus (such as a viral vaccine) that has been rendered incapable of replication in host cells (and is thus not virulent), but can elicit an immune response. Methods of inactivating a virus (such as a virus including a nucleic acid chimera described herein) include chemical treatment (for example, formaldehyde), physical treatment (such as heat), irradiation, or combinations thereof.

Isolated: An "isolated" or "purified" biological component (such as a nucleic acid, peptide, protein, protein complex, or particle) has been substantially separated, produced apart from, or purified away from other components in a preparation or other biological components in the cell of the organism in which the component occurs, that is, other chromosomal and extrachromosomal DNA and RNA, and proteins. Nucleic acids, peptides and proteins that have been "isolated" or "purified" thus include nucleic acids and proteins purified by standard purification methods. The term also embraces nucleic acids, peptides and proteins prepared by recombinant expression in a host cell, as well as chemically synthesized nucleic acids or proteins. The term "isolated" or "purified" does not require absolute purity; rather, it is intended as a relative term. Thus, for example, an isolated biological component is one in which the biological component is more enriched than the biological component is in its natural environment within a cell, or other production vessel. Preferably, a preparation is purified such that the biological component represents at least 50%, such as at least 70%, at least 90%, at least 95%, or greater, of the total biological component content of the preparation.

Nucleic acid molecule: A polymeric form of nucleotides, which may include both sense and anti-sense strands of RNA, cDNA, genomic DNA, and synthetic forms and mixed polymers of the above. A nucleotide refers to a ribonucleotide, deoxynucleotide or a modified form of either type of nucleotide. The term "nucleic acid molecule" as used herein is synonymous with "nucleic acid" and "polynucleotide." A nucleic acid molecule is usually at least 10 bases in length, unless otherwise specified. The term includes single- and double-stranded forms of DNA. A polynucleotide may include either or both naturally occurring and modified nucleotides linked together by naturally occurring and/or non-naturally occurring nucleotide linkages.

Operably linked: A first nucleic acid is operably linked to a second nucleic acid when the first nucleic acid is placed in a functional relationship with the second nucleic acid. Generally, operably linked DNA sequences are contiguous and, where necessary to join two protein coding regions, in the same reading frame. Operably linked nucleic acids include a first nucleic acid contiguous with the 5' or 3' end of a second nucleic acid. In other examples, a second nucleic acid is operably linked to a first nucleic acid when it is embedded within the first nucleic acid, for example, where the nucleic acid construct includes (in order) a portion of the first nucleic acid, the second nucleic acid, and the remainder of the first nucleic acid. Examples of a second nucleic acid embedded within a first nucleic acid are shown schematically in FIGS. 1B-1D.

Pharmaceutically acceptable carrier: The pharmaceutically acceptable carriers (vehicles) useful in this disclosure are conventional. Remington: The Science and Practice of Pharmacy, The University of the Sciences in Philadelphia, Editor, Lippincott, Williams, & Wilkins, Philadelphia, Pa., 21$^{st}$ Edition (2005), describes compositions and formulations suitable for pharmaceutical delivery of one or more therapeutic compositions, such as one or more polyomavirus capsid polypeptide or fragment thereof, and additional pharmaceutical agents.

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (for example, powder, pill, tablet, or capsule forms), conventional non-toxic solid carriers can include, for example, pharmaceutical grades of mannitol, lactose, starch, or magnesium stearate. In addition to biologically-neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

Premembrane protein (prM protein): A *flavivirus* structural protein. The prM protein is an approximately 25 kDa protein that is the intracellular precursor for the membrane (M) protein. prM is believed to stabilize the E protein during transport of the immature virion to the cell surface. When the virus exits the infected cell, the prM protein is cleaved to the mature M protein, which is part of the viral envelope (Reviewed in Lindenbach and Rice, In: *Fields Virology*, Knipe and Howley, eds., Lippincott, Williams, and Wilkins, 991-1041, 2001).

Purified: The term purified does not require absolute purity; rather, it is intended as a relative term. Thus, for example, a purified nucleic acid preparation is one in which the nucleic acid is more enriched than the nucleic acid is in its natural environment (such as within a cell) or in a preparation or production vessel. In other examples, a purified virus preparation is one in which the virus is more enriched than in a cell or organism, a preparation, or a production vessel. A purified nucleic acid or virus also includes one that is substantially free of undesired components, such as an inactivating agent. Preferably, a preparation is purified such that the nucleic acid or virus represents at least 50% of the total content of the preparation. In some embodiments, a purified preparation contains at least 60%, at least 70%, at least 80%, at least 85%, at least 90%, at least 95%, at least 98%, at least 99%, or more of the nucleic acid or virus.

Recombinant nucleic acid: A nucleic acid molecule that is not naturally occurring or has a sequence that is made by an artificial combination of two otherwise separated segments of sequence. This artificial combination is accomplished by chemical synthesis or, more commonly, by the artificial manipulation of isolated segments of nucleic acids, e.g., by genetic engineering techniques such as those described in Sambrook et al. (ed.), *Molecular Cloning: A Laboratory Manual*, 2$^{nd}$ ed., vol. 1-3, Cold Spring Harbor Laboratory Press, Cold Spring Harbor, N.Y., 1989. The term recombinant includes nucleic acids that have been altered solely by addition, substitution, or deletion of a portion of a natural nucleic acid molecule. Exemplary recombinant nucleic acids are shown schematically in FIGS. 1B-1D.

Sequence identity: The similarity between two nucleic acid sequences, or two amino acid sequences, is expressed in terms of the similarity between the sequences, otherwise referred to as sequence identity. Sequence identity is frequently measured in terms of percentage identity (or similarity or homology); the higher the percentage, the more similar the two sequences are.

Methods of alignment of sequences for comparison are well known in the art. Various programs and alignment algorithms are described in: Smith and Waterman (*Adv. Appl. Math.*, 2:482, 1981); Needleman and Wunsch (*J. Mol. Biol.*, 48:443, 1970); Pearson and Lipman (*Proc. Natl. Acad. Sci.*, 85:2444, 1988); Higgins and Sharp (*Gene*, 73:237-44, 1988); Higgins and Sharp (*CABIOS*, 5:151-53, 1989); Corpet et al. (*Nuc. Acids Res.*, 16:10881-90, 1988); Huang et al. (*Comp. Appls. Biosci.*, 8:155-65, 1992); and Pearson et al. (*Meth. Mol. Biol.*, 24:307-31, 1994). Altschul et al. (*Nature Genet.*, 6:119-29, 1994) presents a detailed consideration of sequence alignment methods and homology calculations.

The alignment tools ALIGN (Myers and Miller, *CABIOS* 4:11-17, 1989) or LFASTA (Pearson and Lipman, *Proc. Natl. Acad. Sci.* 85:2444-2448, 1988) may be used to perform sequence comparisons (Internet Program© 1996, W. R. Pearson and the University of Virginia, "fasta20u63" version 2.0u63, release date December 1996). ALIGN compares entire sequences against one another, while LFASTA compares regions of local similarity. These alignment tools and their respective tutorials are available on the Internet at the NCSA website. Alternatively, for comparisons of amino acid sequences of greater than about 30 amino acids, the "Blast 2 sequences" function can be employed using the default BLOSUM62 matrix set to default parameters, (gap existence cost of 11, and a per residue gap cost of 1). When aligning short peptides (fewer than around 30 amino acids), the alignment should be performed using the "Blast 2 sequences" function, employing the PAM30 matrix set to default parameters (open gap 9, extension gap 1 penalties). The BLAST sequence comparison system is available, for instance, from the NCBI web site; see also Altschul et al., *J. Mol. Biol.*, 215:403-10, 1990; Gish and States, *Nature Genet.*, 3:266-72, 1993; Madden et al., *Meth. Enzymol.*, 266:131-41, 1996; Altschul et al., *Nucleic Acids Res.*, 25:3389-402, 1997; and Zhang and Madden, *Genome Res.*, 7:649-56, 1997.

Subject: Living multi-cellular vertebrate organisms, a category that includes both human and non-human mammals (such as mice, rats, rabbits, sheep, horses, cows, and non-human primates).

Transformed: A "transformed" cell is a cell into which has been introduced a nucleic acid molecule (such as a heterologous nucleic acid) by molecular biology techniques. The term encompasses all techniques by which a nucleic acid molecule might be introduced into such a cell, including transfection with viral vectors, transformation with plasmid vectors, and introduction of naked DNA by electroporation, lipofection, and particle gun acceleration.

Vaccine: A preparation of immunogenic material capable of stimulating an immune response, administered for the prevention, inhibition, amelioration, or treatment of infectious or other types of disease. The immunogenic material may include attenuated or inactivated (killed) microorganisms (such as bacteria or viruses), or antigenic proteins, peptides or DNA derived from them. An attenuated virus is a virulent organism that has been modified to produce a less virulent form, but nevertheless retains the ability to elicit antibodies and cell-mediated immunity against the virulent form. An inactivated (killed) virus is a previously virulent organism that has been inactivated with chemicals, heat, or other treatment, but elicits antibodies against the organism. Vaccines may elicit both prophylactic (preventative or protective) and therapeutic responses. Methods of administration vary according to the vaccine, but may include inoculation, ingestion, inhalation or other forms of administration. Vaccines may be administered with an adjuvant to boost the immune response.

III. West Nile/Dengue Virus Chimeras

Disclosed herein are chimeric *flaviviruses* that include non-coding regions, non-structural proteins, and at least a portion of a C protein from WNV, and a prM protein and E protein from DENV. Tables 1-5 below provide start and stop positions of the particular genes and proteins in exemplary West Nile and Dengue viruses. These sequences can serve as reference sequences and may be used to identify particular nucleotide or amino acid positions that correspond to positions referred to in the chimeric nucleic acids disclosed herein, or proteins encoded by the chimeric nucleic acids disclosed herein. For example, based on this information, one of ordinary skill in the art can identify the amino acid position corresponding to E protein amino acid 347 in a DEN2 virus, for example by producing an alignment of a chimera and one of the virus sequences provided herein.

TABLE 1

Start and stop positions of NCRs, structural proteins and nonstructural proteins in WNV clone IC-P991

| Region | Nucleotide start/stop position (SEQ ID NO: 1) | Amino acid start/stop position (SEQ ID NO: 2) |
| --- | --- | --- |
| 5' NCR | 1-96 | — |
| C | 97-465 | 1-123 |
| C(ss) | 412-465 | 106-123 |
| prM | 466-966 | 124-290 |
| M | 742-966 | 216-290 |
| E | 967-2469 | 291-791 |
| NS1 | 2470-3525 | 792-1143 |
| NS2A | 3526-4218 | 1144-1374 |
| NS2B | 4219-4611 | 1375-1505 |
| NS3 | 4612-6468 | 1506-2124 |
| NS4A | 6469-6915 | 2125-2273 |
| NS4B | 6916-7680 | 2274-2528 |
| NS5 | 7681-10395 | 2529-3433 |
| 3' NCR | 10396-11029 | — |

TABLE 2

Start and stop positions of NCRs, structural proteins and nonstructural proteins in DEN1 16007

| Region | Nucleotide start/stop position (SEQ ID NO: 3) | Amino acid start/stop position (SEQ ID NO: 4) |
| --- | --- | --- |
| 5' NCR | 1-94 | — |
| C | 95-436 | 1-114 |
| C(ss) | 395-436 | 101-114 |
| prM | 437-934 | 115-280 |
| M | 710-934 | 206-280 |
| E | 935-2419 | 281-775 |
| NS1 | 2420-3475 | 776-1127 |
| NS2A | 3476-4129 | 1128-1345 |
| NS2B | 4130-4519 | 1346-1475 |
| NS3 | 4520-6376 | 1476-2094 |
| NS4A | 6377-6826 | 2095-2244 |
| NS4B | 6827-7573 | 2245-2493 |
| NS5 | 7574-10270 | 2494-3392 |
| 3' NCR | 10271-10735 | — |

TABLE 3

Start and stop positions of NCRs, structural proteins and nonstructural proteins in DEN2 16681

| Region | Nucleotide start/stop position (SEQ ID NO: 5) | Amino acid start/stop position (SEQ ID NO: 6) |
|---|---|---|
| 5' NCR | 1-96 | — |
| C | 97-438 | 1-114 |
| C(ss) | 397-438 | 101-114 |
| prM | 439-936 | 115-280 |
| M | 712-936 | 206-280 |
| E | 937-2421 | 281-775 |
| NS1 | 2422-3477 | 776-1127 |
| NS2A | 3478-4131 | 1128-1345 |
| NS2B | 4132-4521 | 1346-1475 |
| NS3 | 4522-6375 | 1476-2093 |
| NS4A | 6376-6825 | 2094-2243 |
| NS4B | 6826-7569 | 2244-2491 |
| NS5 | 7570-10269 | 2492-3391 |
| 3' NCR | 10270-10723 | — |

TABLE 4

Start and stop positions of NCRs, structural proteins and nonstructural proteins in DEN3 16562

| Region | Nucleotide start/stop position (SEQ ID NO: 7) | Amino acid start/stop position (SEQ ID NO: 8) |
|---|---|---|
| 5' NCR | 1-94 | — |
| C | 95-436 | 1-114 |
| C(ss) | 395-436 | 101-114 |
| prM | 437-934 | 115-280 |
| M | 710-934 | 206-280 |
| E | 935-2413 | 281-773 |
| NS1 | 2414-3469 | 774-1125 |
| NS2A | 3470-4123 | 1126-1343 |
| NS2B | 4124-4513 | 1344-1473 |
| NS3 | 4514-6370 | 1474-2092 |
| NS4A | 6371-6820 | 2093-2242 |
| NS4B | 6821-7564 | 2243-2490 |
| NS5 | 7565-10264 | 2491-3390 |
| 3' NCR | 10265-10699 | — |

TABLE 5

Start and stop positions of NCRs, structural proteins and nonstructural proteins in DEN4 1036

| Region | Nucleotide start/stop position (SEQ ID NO: 9) | Amino acid start/stop position (SEQ ID NO: 10) |
|---|---|---|
| 5' NCR | 1-101 | — |
| C | 102-440 | 1-113 |
| C(ss) | 399-440 | 100-113 |
| prM | 441-938 | 114-279 |
| M | 714-938 | 205-279 |
| E | 939-2423 | 280-774 |
| NS1 | 2424-3479 | 775-1126 |
| NS2A | 3480-4133 | 1127-1344 |
| NS2B | 4134-4523 | 1345-1474 |
| NS3 | 4524-6377 | 1475-2092 |
| NS4A | 6378-6827 | 2093-2242 |
| NS4B | 6828-7562 | 2243-2487 |
| NS5 | 7563-10262 | 2488-3387 |
| 3' NCR | 10263-10648 | — |

In some examples disclosed herein, the WNV genome used in the chimera is derived from a particular WNV strain, such as NY99 or KEN-3829. Additional WNV strains are known in the art (see, e.g., Ebel et al. *Emerg. Infect. Dis.* 7:650-653, 2001; American Type Culture Collection (ATCC) catalog numbers VR-82, VR-1267, VR-1507, VR-1510). In particular examples, the WNV genome is WN/IC-P991, for example, SEQ ID NO: 1 or GenBank Accession No. AF196835 (incorporated by reference as included in GenBank on Jun. 20, 2014, or with mutations as described in Kinney et al., *J. Gen. Virol.* 87:3611-3622, 2006) and/or U.S. Pat. No. 8,715,689, both of which are incorporated by reference herein in their entirety. In some examples, the WNV genome sequence is modified, for example to introduce restriction sites for cloning purposes. These modifications can be silent mutations (for example, nucleotide sequence changes that do not alter amino acid sequence) or they may change the amino acid sequence.

WNV genome sequences are publicly available. For example, GenBank Accession Nos. AF196835, AY278441, AF202541, AF404754, AF260967, AY660002, AF481864, AY268133, AF404757, AY268132, AF260969, AF317203, AY262283, AY490240, AF260968, AY603654, D00246, M12294, EU068667, AY765264, and AY277251 disclose WNV genomic nucleic acid sequences, all of which are incorporated by reference as included in GenBank on Jun. 20, 2014. In further examples, the WNV genome, or the non-coding regions, non-structural proteins, and/or C protein of the WNV genome are at least 95%, at least 96%, at least 97%, at least 98%, or at least 99% identical to a publicly available WNV genome sequence.

In the disclosed nucleic acid chimeras, the DENV genome is from a Dengue 1 (DEN1), Dengue 2 (DEN2), Dengue 3 (DEN3), or Dengue 4 (DEN4) virus. Exemplary DENV genomes are disclosed herein as SEQ ID NOs: 3, 5, 7, and 9. In some examples, the DENV genome portion of the disclosed chimeras includes sequences from a single DENV genome, while in other examples, the DENV genome portion includes sequences from two or more DENV genomes. The DENV genome may be a wild type strain or an attenuated (or vaccine) strain. In some examples, the DENV genome is DEN2 (for example, wild type DEN2 16681 strain or attenuated DEN-2 PDK-53 strain), DEN1 (for example, wild type DEN1 16007 strain or attenuated DEN1 PDK-13 strain), DEN3 (for example, wild type DEN3 16562 strain or attenuated DEN3 PGMK-30/FRhL-3) or DEN4 (for example, wild type DEN4 1036 or attenuated DEN4 PDK-48). Additional DENV strains are known in the art (see e.g., U.S. Pat. Nos. 5,939,254 and 6,793,488). In particular examples, the DENV genome is a wild type (non-attenuated) strain, for example DEN2 16681 (such as GenBank Accession No. U87411, incorporated by reference as included in GenBank on Jun. 20, 2014). In some examples, the DENV genome sequence is modified, for example to introduce restriction sites for cloning purposes. These modifications can be silent mutations (for example, nucleotide sequence changes that do not alter amino acid sequence) or they may change the amino acid sequence.

DENV sequences are publicly available. For example GenBank Accession Nos. NC_001477, AF180817, and U88536 disclose DEN1 nucleic acid sequences; NC_001474 and U87411 disclose DEN2 nucleic acid sequences; NC_001475, AY099336, and AF317645 disclose DEN3 nucleic acid sequences; and NC_002640 and AF326825 disclose DEN4 nucleic acid sequences, all of which are incorporated by reference as included in GenBank on Jun. 20, 2014. In additional examples, the DENV genome (or the C signal sequence, prM, and/or E protein from the DENV genome) are at least 95%, at least 96%, at least 97%, at least 98%, or at least 99% identical to a publicly available DENV sequence.

The viruses containing the disclosed nucleic acid chimeras can readily be produced by replication in host cells in culture. Methods of producing viruses are well known in the art (see e.g. *Fields Virology*, Knipe and Howley, eds., Lippincott, Williams, and Wilkins, 2001; Flint et al., *Principles of Virology*, ASM Press, 2000). Host cell lines are generally selected to be easy to infect with virus or transfect with viral genomic RNA, capable of stably maintaining foreign RNA with an unarranged sequence, and have the necessary cellular components for efficient transcription, translation, post-translation modification, virus assembly, and secretion of the protein or virus particle. In addition cells are typically those having simple media component requirements which can be adapted for growth in suspension culture. In some examples, the host cell line is a mammalian cell line that is adapted to growth in low serum or serum-free medium. Exemplary suitable host cell lines include Vero (monkey), C6/36 (mosquito), BHK21 (hamster), LLC-MK2 (monkey) SK6 (swine), L292 (mouse), HeLa (human), HEK (human), 2fTGH cells (human), HepG2 (human), and PDK (dog) cells. Suitable cell lines can be obtained from the American Type Culture Collection (ATCC), Manassas, Va.

In some examples, the disclosed chimeric WN/DEN viruses replicate in cell culture more rapidly than DEN viruses. In some examples, plaques formed by WN/DEN chimeric viruses form on cell cultures (such as C6/36 or Vero cells) sooner than DENVs (such as at least one day, two days, three days, four days, or five days post-infection sooner). In other examples, WN/DEN chimeric viruses form larger plaques than DENVs, for example, plaques that are at least 25% larger to about 10 times larger than DEN viruses (such as at least 50% larger, two-fold, three-fold, four-fold, five-fold, or up to 10-fold larger).

The disclosure also provides WN/DEN chimeras having one or more nucleic acid or amino acid substitutions, insertions, deletions, or combinations thereof, such that the resulting chimera has improved characteristics. In some examples, the improved characteristic of the chimera includes but is not limited to increased virus titer, increased replication rate, increased plaque size, or increased stability in cell culture compared to a wild type virus. In additional examples, the improved characteristic of the chimera includes increased infectivity or virulence in a subject (such as mice or non-human primates) or decreased infectivity or transmissibility in mosquitoes as compared to a wild type virus.

Manipulation of the nucleotide sequence of the disclosed chimeric *flaviviruses* by standard procedures, including for instance site-directed mutagenesis or PCR and M13 primer mutagenesis, can be used to produce variants with improved characteristics (such as increased virus titer or stability in cell culture). Details of these techniques are well known. For instances, protocols are provided in Sambrook et al. (ed.), *Molecular Cloning: A Laboratory Manual*, 2$^{nd}$ ed., vol. 1-3, Cold Spring Harbor Laboratory Press, Cold Spring Harbor, N.Y., 1989. The simplest modifications involve the substitution of one or more amino acids for amino acids having similar physiochemical and/or structural properties. These so-called conservative substitutions are likely to have minimal impact on the activity and/or structure of the resultant protein. Conservative substitutions generally maintain (a) the structure of the polypeptide backbone in the area of the substitution, for example, as a sheet or helical conformation, (b) the charge or hydrophobicity of the molecule at the target site, or (c) the bulk of the side chain. Examples of conservative substitutions are shown below.

| Original Residue | Conservative Substitutions |
| --- | --- |
| Ala | Ser |
| Arg | Lys |
| Asn | Gln, His |
| Asp | Glu |
| Cys | Ser |
| Gln | Asn |
| Glu | Asp |
| His | Asn; Gln |
| Ile | Leu, Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

The substitutions which in general are expected to produce the greatest changes in protein properties will be non-conservative, for instance changes in which (a) a hydrophilic residue, for example, seryl or threonyl, is substituted for (or by) a hydrophobic residue, for example, leucyl, isoleucyl, phenylalanyl, valyl or alanyl (or vice versa); (b) a cysteine or proline is substituted for (or by) any other residue; (c) a residue having an electropositive side chain, for example, lysyl, arginyl, or histadyl, is substituted for (or by) an electronegative residue, for example, glutamyl or asparty (or vice versa); or (d) a residue having a bulky side chain, for example, phenylalanine, is substituted for (or by) one not having a side chain, for example, glycine (or vice versa).

In addition to targeted mutagenesis to produce variants of the disclosed WN/DENV chimeras, mutations may accrue upon passage in cell culture that result in variants, some with desirable characteristics. Nucleic acid and amino acid substitutions, insertions, and/or deletions that accrue in chimeric viruses during cell culture passages are readily determined by sequence analysis of the virus amplified from isolated plaques of the virus seed, and can be engineered into infectious clones to generate WN/DENV chimera variants that have improved characteristics (such as replication to high titer or production of uniform large plaques in cells). Consistent mutations identified from multiple seeds or isolated plaques are one indication of a desirable substitution of the chimera in the cell type. Previous studies have successfully identified substitutions which occurred in cell culture and engineered these into different chimeric virus constructs to produce chimeric viruses with improved characteristics (e.g., Huang et al., *J. Virol.* 77:11436-11447, 2003; Huang et al., *J. Virol.* 12:7300-7310, 2005; U.S. Pat. No. 8,715,689).

A. WN/DEN Chimeras with Chimeric prM Signal Sequence

Figure 1B:
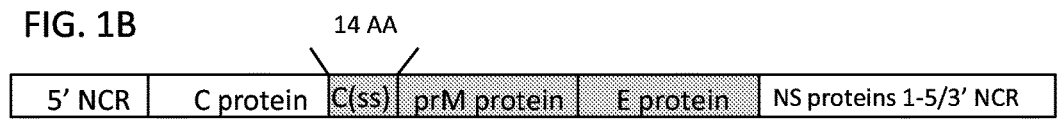
Figure 1C:
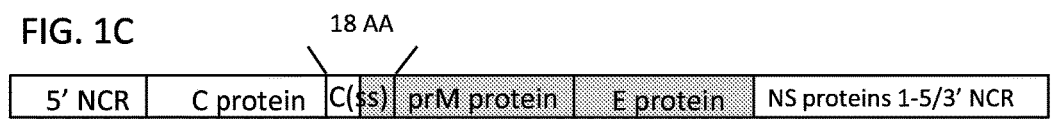

In some embodiments, the WN/DEN chimeric nucleic acids disclosed herein include a first nucleic acid molecule including a 5' non-coding region, a nucleic acid encoding a C protein and non-structural proteins, and a 3' non-coding region from a West Nile virus genome, where the C protein includes a portion of a prM signal sequence (also referred to as "C(ss)") from WNV and a portion of a prM signal sequence from a DENV genome. The chimera also includes a second nucleic acid molecule operably linked to the first nucleic acid molecule, encoding at least a portion of a prM protein and E protein from a DENV genome. In particular examples, the nucleic acid molecules encoding the prM protein and E protein of the WNV genome are replaced with molecules having the corresponding sequences from the DENV genome. In addition, a portion of the WNV prM signal sequence of the C protein is replaced with a portion of the prM signal sequence of the C protein from a DENV, producing a chimeric or "mixed" signal sequence. A schematic illustration of an exemplary chimera of this construction is shown in FIG. 1C (and is referred to herein in some examples as a nucleic acid chimera having a "Type II" junction or a "Type II chimera"). Thus, in some examples, the second nucleic acid is embedded within the first nucleic acid, such that the chimera includes (in order) WNV 5' NCR, WNV C protein that includes at least an N-terminal portion of the WNV C(ss), DENV C-terminal portion of the C(ss), DENV prM protein, DENV E protein, WNV non-structural proteins (NS1-NS5), and WNV 3' NCR.

The nucleic acid chimeras with a Type II junction have a C(ss) that is the same length as the C(ss) of the native WNV C(ss), which is 18 amino acids. A 5' portion of the C(ss) is from a WNV genome and a 3' portion of the C(ss) is from a DENV genome. In particular examples of nucleic acid chimeras with a Type II junction, the C(ss) includes the first six amino acids of the WNV C(ss) (e.g., amino acids 106-111 of SEQ ID NO: 2) and the last 12 amino acids of a DENV C(ss) (e.g., amino acids 103-114 of SEQ ID NO: 4, 6, or 8 or amino acids 102-113 of SEQ ID NO: 10). For example, the C(ss) of a Type II WN/DEN1 chimera has the sequence GGKTGITMLLMLLPTALA (SEQ ID NO: 21), the C(ss) of a Type II WN/DEN2 chimera has the sequence GGKTGIGMIIMLIPTVMA (SEQ ID NO: 22), the C(ss) of a Type II WN/DEN3 chimera has the sequence GGKTGILCLMMMLPATLA (amino acids 106-123 of SEQ ID NO: 16), and the C(ss) of a Type II WN/DEN4 chimera has the sequence GGKTGIITLLCLIPTVMA (SEQ ID NO: 23). An exemplary WN/DEN3 chimera with a type II junction is provided herein as SEQ ID NOs: 15 and 16.

In additional examples, a "hybrid" C(ss) of the Type II junction (providing a C(ss) of 18 amino acids, but with both WNV and DENV amino acids) may include the first 11-17 amino acids of the WNV C(ss) and the last 1-7 amino acids of a DENV C(ss). Thus, additional type II junctions may include the first 11 amino acids of the WNV C(ss) and the last 7 amino acids of a DENV C(ss), the first 12 amino acids of the WNV C(ss) and the last 6 amino acids of a DENV C(ss), and so on.

In some examples, the disclosed WN/DEN chimeras include one or more nucleic acid substitutions that result in an amino acid substitution that provides a desirable characteristic, for example, increased stability, replication, or virus titer in cell culture (such as Vero or C6/36 cells) compared to the unsubstituted virus or chimera. Exemplary amino acid substitutions include a substitution at an amino acid position corresponding to E protein amino acid 345 of DEN3 or E protein amino acid 347 of DEN1, DEN2, or DEN4. In some examples, the amino acid substitution results in the presence of a leucine residue at amino acid position 345 of DEN3 (His-Leu change) or 347 of DEN1, DEN2, or DEN4 (Gln-Leu change). Exemplary nucleic acid substitutions that result in these substitutions are provided in Table 7, below. An exemplary type II chimera including a substitution at an amino acid position corresponding to E protein amino acid 345 of DEN3 or E protein amino acid 347 of DEN1, DEN2, or DEN4 is provided herein as WN/DEN3 chimera of SEQ ID NOs: 15 and 16.

B. WN/DEN Chimeras with Dengue prM Signal Sequence

In some embodiments, the WN/DEN chimeric nucleic acids disclosed herein include a first nucleic acid molecule including a 5' non-coding region, a nucleic acid encoding a C protein and non-structural proteins, and a 3' non-coding region from a West Nile virus genome, where the C protein does not include a WNV prM signal sequence (e.g., the chimera includes a prM signal sequence from a DENV genome). The chimera also includes a second nucleic acid molecule operably linked to the first nucleic acid molecule, encoding a prM signal sequence and at least a portion of a prM protein and E protein from a DENV genome. In particular examples, the nucleic acid molecules encoding the prM signal sequence, the prM protein and the E protein of the WNV genome are replaced with molecules having the corresponding sequences from the DENV genome. A schematic illustration of an exemplary chimera of this construction is shown in FIG. 1B (and is referred to herein in some examples as a nucleic acid chimera having a "Type I" junction or a "Type I chimera"). Thus, in some examples, the second nucleic acid is embedded within the first nucleic acid, such that the chimera includes (in order) WNV 5' NCR, WNV C protein excluding the C(ss), DENV C(ss), DENV prM protein, DENV E protein, WNV NS1-NS5, and WNV 3' NCR.

The nucleic acid chimeras with a Type I junction have a prM signal sequence (also referred to as "C(ss)") from a DENV, which is 14 amino acids (instead of the 18 amino acid WNV C(ss) sequence). Exemplary WN/DEN chimeras with a type I junction include SEQ ID NOs: 11-14, 19, and 20.

In some examples, the disclosed WN/DEN chimeras include one or more nucleic acid substitutions that result in an amino acid substitution that provides a desirable characteristic, for example, increased stability, replication, or virus titer in cell culture (such as Vero or C6/36 cells) compared to the unsubstituted virus or chimera. Exemplary nucleic acid and amino acid substitutions include those shown in Table 7, below. For example, the WN/DEN chimera may include one or more substitutions including an amino acid substitution at one or more amino acid corresponding to C protein amino acid position 92 of WNV; C protein amino acid position 101 of DEN1, DEN2, or DEN3; C protein amino acid position 100 of DEN4; C protein amino acid position 102 of DEN1, DEN2, or DEN3; C protein amino acid position 101 of DEN4; an amino acid substitution at one or more of an amino acid corresponding to prM protein amino acid position 22, 135, 154, or 155 of DEN1, DEN2, DEN3, or DEN4; an amino acid substitution at one or more of an amino acid corresponding to E protein amino acid position 171 of DEN1, DEN2, DEN3, or DEN4; E protein amino acid position 311 of DEN1, DEN2 or DEN4; E protein amino acid position 309 of DEN3; E protein amino acid position 347 of DEN1, DEN2, or DEN4; E protein amino acid position 345 of DEN3; E protein amino acid position 397 of DEN1, DEN2, or DEN4; E protein amino acid position 395 of DEN3; E protein amino acid position 417 of DEN1, DEN2, or DEN4; E protein amino acid position 415 of DEN3; a substitution at NS3 protein amino acid position 71 of WNV; and/or a substitution at NS4A protein amino acid position 18 of WNV.

In some examples, two or more substitutions are present in a chimera disclosed herein. In one example, a WN/DEN chimera includes a substitution at an amino acid position corresponding to E protein amino acid 201 of DEN3 or E protein amino acid 203 of DEN1, DEN2, or DEN4 and a substitution at an amino acid position corresponding to C protein amino acid position 100 of DEN4 or 101 of DEN1, DEN2, or DEN3. In another example, a WN/DEN chimera includes a substitution at an amino acid position corresponding to prM protein amino acid 135 of DEN1, DEN2, DEN3 or DEN4 and a substitution at an amino acid position corresponding to prM amino acid position 154 of DEN4 or 101 of DEN1, DEN2, or DEN3.

In one particular example, a WN/DEN chimera with a type I junction includes a substitution at an amino acid position corresponding to E protein amino acid 201 of DEN3 or E protein amino acid 203 of DEN1, DEN2, or DEN4. In some examples, the amino acid substitution results in the presence of an aspartic acid residue at E protein amino acid position 201 of DEN3 (Asn-Asp change) or 203 of DEN1 (Glu-Asp change), DEN2 (Asn-Asp change), or DEN4 (Lys-Asp change). An exemplary type I chimera including a substitution at an amino acid position corresponding to E protein amino acid position 201 of DEN3 or 203 of DEN1, DEN2, or DEN4 is provided herein as SEQ ID NOs: 13 and 14 (previously described in U.S. Pat. No. 8,715,689). In other examples, the amino acid substitution results in the presence of an serine or proline at a position corresponding to C protein amino acid position 101 of DEN4 (Thr-Pro change) or 102 of DEN1 (Val-Pro change), DEN2 (Ala-Pro change), or DEN3 (Ser-Pro change). An exemplary type I chimera including a substitution at an amino acid position corresponding to C protein amino acid position 101 of DEN4 or 102 of DEN1, DEN2, or DEN3 is provided herein as WN/DEN4 chimera of SEQ ID NOs: 19 and 20.

C. WN/DEN Chimeras with West Nile prM Signal Sequence

Figure 1D:
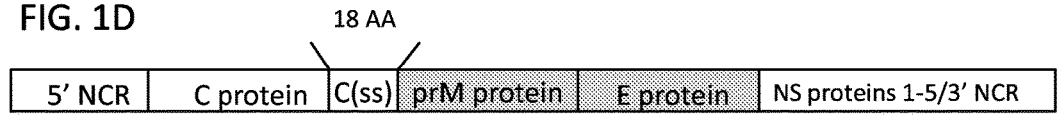

In some embodiments, the WN/DEN chimeric nucleic acids disclosed herein include a first nucleic acid molecule including a 5' non-coding region, a nucleic acid encoding a C protein and non-structural proteins, and a 3' non-coding region from a West Nile virus genome. The chimera also includes a second nucleic acid molecule operably linked to the first nucleic acid molecule, encoding at least a portion of a prM protein and E protein from a DENV genome. In particular examples, the nucleic acid molecules encoding the prM protein and the E protein of the WNV genome are replaced with molecules having the corresponding sequences from the DENV genome. A schematic illustration of an exemplary chimera of this construction is shown in FIG. 1D (and is referred to herein in some examples as a nucleic acid chimera having a "Type III" junction or a "Type III chimera"). Thus, in some examples, the second nucleic acid is embedded within the first nucleic acid, such that the chimera includes (in order) WNV 5' NCR, WNV C protein, DENV prM protein, DENV E protein, WNV NS1-NS5, and WNV 3' NCR.

The nucleic acid chimeras with a Type III junction have a prM signal sequence (also referred to as "C(ss)") from WNV, which is 18 amino acids (instead of the 14 amino acid DENV C(ss) sequence). An exemplary WN/DEN chimera with a type III junction includes SEQ ID NOs: 17 and 18.

In some examples, the disclosed WN/DEN chimeras include one or more nucleic acid substitutions that result in an amino acid substitution that provides a desirable characteristic, for example, increased stability, replication, or virus titer in cell culture (such as Vero or C6/36 cells) compared to the unsubstituted virus or chimera. Exemplary amino acid substitutions include a substitution at an amino acid position corresponding to E protein amino acid 345 of DEN3 or E protein amino acid 347 of DEN1, DEN2, or DEN4. In some examples, the amino acid substitution results in the presence of a leucine residue at amino acid position 345 of DEN3 (His-Leu change) or 347 of DEN1 (Gln-Leu change), DEN2 (Val-Leu change), or DEN4 (Gln-Leu change). Exemplary nucleic acid substitutions that result in these substitutions are provided in Table 7, below. An exemplary type III chimera including a substitution at an amino acid position corresponding to E protein amino acid 345 of DEN3 or E protein amino acid 347 of DEN1, DEN2, or DEN4 is provided herein as WN/DEN3 chimera of SEQ ID NOs: 17 and 18.

IV. Compositions and Methods for Eliciting an Immune Response

Provided herein are methods of eliciting an immune response in a subject by administering one or more inactivated viruses including a WN/DEN chimeric nucleic acid (such as one or more of the disclosed nucleic acid chimeras) to the subject. In a particular example, the subject is a human. The inactivated virus comprising a WN/DENV nucleic acid chimera is used to produce an immune response that prevents or inhibits infection with a DENV (such as DENV1, DENV2, DENV3, or DENV4), and can also be used to treat or inhibit infection with DENV.

In some examples, the method further includes selecting a subject in need of enhanced immunity to DENV. Subjects in need of enhanced immunity to DENV include subjects who are at risk of DENV infection, subjects who have been exposed to one or more DENV, and subjects who are infected with DENV. Residents of, or travelers to, countries or regions where DENV is endemic are at risk of contracting DENV. Additional factors that contribute to risk of infection with DENV include the characteristics of the area, presence of DENV in the area, exposure to mosquitos, and lack of preventive measures (such as insect repellant).

In some examples, one, two, three, four, or more inactivated WN/DEN chimeric viruses are administered to a subject. If two or more inactivated chimeric viruses are administered, they can be administered separately (for example, in separate immunogenic compositions that are administered to the subject within a short period of time) or they can be administered substantially simultaneously (for example, in a single immunogenic composition including two or more inactivated chimeric viruses). In some examples, inactivated WN/DEN1, WN/DEN2, WN/DEN3, and WN/DEN4 viruses are administered to a subject either separately (for example, sequentially, in any order) or simultaneously (in a single (multivalent) immunogenic composition). The inactivated WN/DEN chimeras can include any combination of those disclosed herein and/or those disclosed in U.S. Pat. No. 8,715,689 (incorporated herein by reference in its entirety). In a particular example, four inactivated WN/DEN chimeric viruses are administered to a subject (sequentially or simultaneously), for example, an inactivated WN/DEN1 chimeric virus with a type I junction (such as the WN/DEN1 chimera provided herein as SEQ ID NOs: 11 and 12), an inactivated WN/DEN2 chimeric virus with a type II junction and an Asn-Asp substitution at E protein amino acid position 203 (such as the WN/DEN2 chimera provided herein as SEQ ID NOs: 13 and 14), an inactivated WN/DEN3 chimeric virus with a type II or type III junction and a His-Leu substitution at E protein amino acid position 345 (such as the WN/DEN3 chimeras provided herein as SEQ ID NOs: 15-18), and an inactivated WN/DEN4 chimeric virus with a type I junction and a Thr-Pro substitution at C protein amino acid position corresponding to C protein amino acid 101 (such as the WN/DEN4 chimera provided herein as SEQ ID NOs: 19 and 20). In other examples, two or three inactivated WN/DENV chimeric viruses are administered to a subject (sequentially or simultaneously), for example, an inactivated WN/DEN3 chimeric virus with a type II or type III junction and a His-Leu substitution at E protein amino acid position 345 (such as the WN/DEN3 chimeras provided herein as SEQ ID NOs: 15-18), and an inactivated WN/DEN4 chimeric virus with a type I junction and a Thr-Pro substitution at C protein amino acid position corresponding to C protein amino acid 101 (such as the WN/DEN4 chimera provided herein as SEQ ID NOs: 19 and 20). Administration of one, two, or three inactivated chimeric viruses may be particularly useful when the inactivated viruses are used as a boost for a live-attenuated DENV vaccine, for example to achieve more balanced immunity to all four DENV serotypes (see Example 7).

In some examples, the chimeric virus is inactivated, for example, using chemical inactivation, high pressure inactivation, ultraviolet or gamma irradiation, or any combination thereof. For example, chemical inactivation includes exposing the virus to one or more of formaldehyde (e.g., formalin), β-propiolactone, aziridines, hydrogen peroxide, organic solvents, surfactants (e.g., sarkosyl) or non-ionic detergents (e.g., Triton®-X100), or ascorbic acid for a time sufficient to inactivate the virus. In one example, the virus is inactivated using an oxidizing agent such as hydrogen peroxide, for example, treatment with about 0.05-5% hydrogen peroxide (such as about 0.1-1% about 0.5-3%, about 1-5%) at room temperature for about 1-24 hours (such as about 1-16 hours, about 2-12 hours, about 4-8 hours, about 1-6 hours, for example, about 1 hour, about 2 hours, about 3 hours, about 4 hours, about 6 hours, about 8 hours, about 12 hours, about 16 hours, or about 24 hours). See, e.g., WO 2008/039171; Amanna et al., *Nat. Med.* 18:974-979, 2012; Pinto et al., *J. Virol.* 87:1926-1936, 2013. One of ordinary skill in the art can determine optimal hydrogen peroxide concentrations and conditions for inactivation for different starting viral titers or volumes.

In a particular, non-limiting example, the virus (such as one or more WN/DENV chimeras disclosed herein) is treated with about 0.001-0.5% sarkosyl (such as about 0.005-0.4%, about 0.025-0.2%, or about 0.01-0.4% sarkosyl, for example, about 0.005%, about 0.01%, about 0.025%, about 0.05%, about 0.1%, about 0.2%, about 0.3%, about 0.4%, or about 0.5% sarkosyl) at about 20-37° C. (for example, about 20-37° C., about 22-30° C., about 30-37° C., or about room temperature) for a sufficient time to inactivate the virus (such as about 15 minutes to 3 hours, about 30 minutes to 2 hours, about 1-2 hours or about 30 minutes to 90 minutes). One of ordinary skill in the art can determine optimal detergent concentrations and conditions for inactivation for other detergents and/or different starting viral titers or volumes, for example using the methods described in Example 5. In some examples, longer inactivation times are used at lower temperatures (such as room temperature) than at higher temperatures (such as 37° C.). One of ordinary skill in the art can determine inactivation times based on the temperature of treatment and routine experimentation.

In other examples, the virus is exposed to an ultraviolet light source (such as a UV-C light source of 254 nm) or a radioactive source (such as cobalt-60) for a time sufficient to inactivate the virus. In some examples, the virus (such as one or more WN/DENV chimeras disclosed herein) is exposed to about 350-700 μW/cm² (such as about 350-680 μW/cm², about 400-670 μW/cm², about 670-685 μW/cm², or about 350 μW/cm², about 670 μW/cm², or about 680 μW/cm²) of UV-254 nm for about 10 minutes to 2 hours (such as about 15 minutes to 1 hour, about 15-45 minutes, about 1-2 hours, about 15 minutes, about 30 minutes, about 45 minutes, about 1 hour, or more). In other examples, the virus (such as one or more WN/DENV chimeras disclosed herein) is exposed to about 0.1-200 mW/cm² (such as about 0.5-5 mW/cm², about 1-10 mW/cm², about 10-50 mW/cm², about 25-100 mW/cm², about 100-200 mW/cm², for example, about 2 mW/cm², about 5 mW/cm², about 10 mW/cm², about 50 mW/cm2, about 100 mW/cm², about 150 mW/cm², or about 200 mW/cm²) for about 10 minutes to 8 hours (such as about 30 minutes to 1 hour, about 1-6 hours, about 2-4 hours, about 15 minutes, about 30 minutes, about 1 hour, about 2 hours, about 3 hours, about 4 hours, about 6 hours, about 8 hours). In some examples, the virus in kept cool (for example at 4° C. or on ice) during UV treatment. In particular examples, small volumes (such as less than about 1 ml) are treated at 670 μW/cm² for 15 minutes or 350 μW/cm² for 45 minutes and larger volumes (such as about 1 ml or more, for example about 2-5 ml, about 1-3 ml, or more) are treated at 680 μW/cm² for 45 minutes or more. One of ordinary skill in the art can determine optimal UV power and conditions for inactivation for other volumes or different starting viral titers, for example using the methods described in Example 5.

In additional examples, the virus is inactivated by photochemical inactivation. The methods include exposure of the virus to UV radiation (365 nm) in the presence of photo-activatable chemicals, such as 1,5-indonaphthylazide (INA), 4'-aminomethyl-trioxsalen (AMT), 8-methoxypsoralen (MOP), 4,5',8-trimethylpsoralen (TMP), or psoralen. See, e.g., Raviprakash et al., *Hum Vaccines Immunother.* 9:2336-2341, 2013; Raviv et al., *J. Virol.* 82:4612-4619, 2008; Sharma et al., *Vaccine* 29:953-959, 2011; Hanson et al., *J. Gen. Virol.* 40:345-358, 1978. In particular examples, the virus (such as one or more WN/DENV chimeras disclosed herein) is exposed to about 0.1-200 mW/cm² (such as about 0.1-1 mW/cm², about 0.5-5 mW/cm², about 1-100 mW/cm², about 100-200 mW/cm², for example, about 2 mW/cm², about 100 mW/cm², about 145 mW/cm², about 180 mW/cm², or about 200 mW/cm²) of UV-365 nm for about 1 minute to about 6 hours (such as about 2-15 minutes, about 5-30 minutes, about 15 minutes to 1 hour, about 15-45 minutes, about 1-2 hours, about 90 minutes to 4 hours, about 2-6 hours, about 2 minutes, about 5 minutes, about 10 minutes, about 15 minutes, about 30 minutes, about 45 minutes, about 1 hour, about 2 hours, about 4 hours, about 6 hours, or more) in the presence of INA, ANT, MOP, TMP, or psoralen. One of ordinary skill in the art can determine optimal UV power and conditions for inactivation using particular compounds, virus volumes, or starting viral titers, for example using the methods described in Example 5.

After the chimeric virus has been inactivated, the inactivated virus may be purified. Purification methods include filtration or diafiltration, chromatography (e.g., size exclusion, ion exchange, or immunoaffinity chromatography), density-gradient centrifugation, glycerol-cushion centrifugation, or Cullufine® sulfate media chromatography. In other examples, the chimeric virus is purified prior to inactivation. If purified virus is inactivated, an additional purification step may be included following inactivation, for example, to remove a chemical inactivation agent (such as detergent), for example using filtration or buffer exchange. Preparations of purified inactivated WN/DENV chimeras may include both inactivated whole virus and inactivated virus-like particles.

In some examples, chimeras are purified (for example, through polyethylene glycol 8000 (PEG8000) precipitation and gradient-density centrifugation, glycerol cushion centrifugation, and/or Cellufine® sulfate media chromatography) before inactivation. Inactivated viruses may be further purified by filtration to remove inactivating reagent, for example, if necessary. In particular examples, detergent (such as sarkosyl) is removed after inactivation by filtration, detergent removal spin columns (such as Millipore Detergent-OUT™ kits), dialysis, or ion-exchange chromatography. Final product may be tested for infectivity in cell cultures (for example as described in Examples 1 and 2), antigenicity (for example, by ELISA; as discussed in Section VI, below), and/or protein concentration (for example, by Bradford or bicinchoninic acid protein assay).

One or more purified inactivated viruses comprising a WN/DEN nucleic acid chimera (for example in the form of a pharmaceutical or immunogenic composition) are administered to a subject by any of the routes normally used for introducing a composition into a subject. Methods of administration include, but are not limited to, intradermal, intramuscular, intraperitoneal, parenteral, intravenous, subcutaneous, vaginal, rectal, intranasal, inhalation or oral. Parenteral administration, such as subcutaneous, intravenous or intramuscular administration, is generally achieved by injection. Injectables can be prepared in conventional forms, either as liquid solutions or suspensions, solid forms suitable for solution or suspension in liquid prior to injection, or as emulsions. Injection solutions and suspensions can be prepared from sterile powders, granules, and tablets of the kind previously described. Administration can be systemic or local.

Immunogenic compositions are administered in any suitable manner, such as with pharmaceutically acceptable carriers. Pharmaceutically acceptable carriers are determined in part by the particular composition being administered, as well as by the particular method used to administer the composition. See, e.g., *Remington: The Science and Practice of Pharmacy*, The University of the Sciences in Philadelphia, Editor, Lippincott, Williams, & Wilkins, Philadelphia, Pa., $21^{st}$ Edition (2005). Accordingly, there is a wide variety of suitable formulations of pharmaceutical compositions of the present disclosure.

Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishers, electrolyte replenishers (such as those based on Ringer's dextrose), and the like. Preservatives and other additives may also be present such as, for example, antimicrobials, anti-oxidants, chelating agents, and inert gases and the like.

In some examples, the compositions disclosed herein include one or more adjuvants. In other examples, an adjuvant is not included in the composition, but is separately administered to a subject (for example, in combination with a composition disclosed herein) before, after, or substantially simultaneously with administration of one or more of the compositions disclosed herein. Adjuvants are agents that increase or enhance an immune response in a subject administered an antigen, compared to administration of the antigen in the absence of an adjuvant. One example of an adjuvant is an aluminum salt, such as aluminum hydroxide, aluminum phosphate, aluminum potassium sulfate, or aluminum hydroxyphosphate. Other adjuvants include biological adjuvants, such as cytokines (for example, IL-2, IL-6, IL-12, RANTES, GM-CSF, TNF-α, or IFN-γ), growth factors (for example, GM-CSF or G-CSF), one or more molecules such as OX-40L or 4-1 BBL, immunostimulatory oligonucleotides (for example, CpG oligonucleotides), Toll-like receptor agonists (for example, TLR2, TLR4, TLR7/8, or TLR9 agonists), and bacterial lipopolysaccharides or their derivatives (such as 3D-MPL). Additional adjuvants include oil and water emulsions, squalene, or other agents. In one example, the adjuvant is a mixture of stabilizing detergents, micelle-forming agent, and oil available under the name PROVAX® (IDEC Pharmaceuticals, San Diego, Calif.). One of skill in the art can select a suitable adjuvant or combination of adjuvants to be included in the compositions disclosed herein or administered to a subject in combination with the compositions disclosed herein.

Administration is accomplished by single or multiple doses. The dose administered to a subject in the context of the present disclosure should be sufficient to induce a beneficial therapeutic response in a subject over time, or to inhibit or prevent DENV infection. The dose required will vary from subject to subject depending on the species, age, weight and general condition of the subject, the severity of the infection being treated, the particular immunogenic composition being used, and its mode of administration. An appropriate dose can be determined by one of ordinary skill in the art using only routine experimentation. In some examples, the dose of each inactivated virus (such as in an immunogenic composition) administered to the subject is about 0.1 μg to about 100 μg. For example, a dose of the immunogenic composition can contains at least 0.1 μg, at least 0.2 μg, at least 0.25 μg, at least 0.3 μg, at least 0.33 μg, at least 0.4 μg, at least 0.5 μg, at least 1.0 μg, at least 2.0 μg, at least 3.0 μg, at least 5.0 μg, or at least 10.0 μg, (or any amount between 0.1 and 10.0 μg) of each serotype of virus. In other examples, a dose of the immunogenic composition contains no more than 100 μg of each serotype of virus, for example, no more than 90 μg, 80 μg, 75 μg, 70 μg, 60 μg, or 50 μg, 40 μg, 30 μg, 20 μg, 10 μg (or any amount between 10 and 100 μg) of each serotype of virus.

Repeated immunizations may be necessary to produce an immune response in a subject. When administered in multiple doses, the booster doses are administered at various time intervals, such as weeks or months to years. In other examples, the inactivated WN/DEN chimeric viruses are used as a booster following administration of one or more DEN vaccines (for example, live-attenuated recombinant vaccines disclosed in U.S. Pat. No. 7,094,411). In one example, a subject is administered a prime dose of DENV vaccine (such as a live-attenuated tetravalent DENV composition) followed by at least one boost dose of one or more (such as 1, 2, 3, or 4) of the inactivated WN/DENV chimeric viruses disclosed herein. In some examples, the boost dose is administered about 14, 30, 60, 90, or more days after administration of the prime dose. Additional boosters (of live-attenuated DENV or inactivated WN/DENV chimeras) can be administered at subsequent time points, if determined to be necessary or beneficial. Immunization protocols (such as amount of immunogen, number of doses and timing of administration) can be determined experimentally, for example by using animal models (such as mice or non-human primates), followed by clinical testing in humans.

V. Preparation of Viruses

Methods of cell culture, viral replication, plaque titration, and virus or virus particle purification are well known in the art. See e.g. Obijeski et al., *J. Gen. Virol.* 22:21-33, 1974;

Beaty et al., *Diagnostic Procedures for Viral, Ricksettial, and Chlamydial Infections*, pp. 189-212, Lennette et al. (eds.), 7th Edition, American Public Health Association, 1995; *Virology Methods Manual*, Mahy and Kangro (eds.), Academic Press, 1996.

The chimeric viruses of the present invention can be made using standard methods known and recognized in the art. For example, an RNA molecule corresponding to the genome of a virus, or a chimeric virus, can be introduced into primary cells, chick embryos, or diploid cell lines, from which (or the supernatants of which) progeny virus can then be purified. Another method that can be used to produce the viruses employs heteroploid cells, such as Vero cells (Yasumura et al., *Nihon Rinsho* 21:1201-1215, 1963) or C6/36 cells. In this method, a nucleic acid molecule (e.g., an RNA molecule) corresponding to the genome of a virus or chimeric virus is introduced into the heteroploid cells and virus is harvested from the medium in which the cells have been cultured. The harvested virus can then be then concentrated (e.g., by PEG 8000 precipitation, use of ultrafiltration using a filter having a molecular weight cut-off of, e.g., 50-500 kDa (e.g., Amicon ultracentrifugal filter, tangential flow filtration cassette, or Pellicon-2 Mini ultrafilter cassette)), diafiltered against MEME without phenol red or FBS, formulated by the addition of lactose, and filtered into a sterile container. Details of a method of virus production are provided in WO 03/060088. Viruses optionally are further purified, for example by density gradient centrifugation, glycerol cushion centrifugation, and/or Cellufine® sulfate media chromatography (see, e.g., Example 5).

VI. Detection of *Flavivirus* Antibodies

The present disclosure further provides a method of detecting a *flavivirus*-reactive antibody in a sample (such as a sample from a subject, for example, a blood sample), including contacting the sample with a chimeric virus of this disclosure under conditions whereby an antibody/polypeptide complex can form; and detecting formation of the complex, thereby detecting *flavivirus* antibody in a sample. An advantage of the disclosed WN/DEN chimeras is that they grow faster and to higher titers and produce larger and more well-defined plaques than wild type DENV. Therefore, the disclosure provides methods of detecting DENV-reactive antibody in a sample that are faster and more specific than methods utilizing wild type DENV (see, e.g., FIGS. 4, 5A, and 5B). For example, the specificity of the assay (for example to distinguish between DENV serotypes) may be improved by use of the disclosed chimeras which include amino acid substitutions in the E protein which reduce antibody cross-reactivity.

The methods of detecting *flavivirus*-reactive antibody in a sample are performed, for example, by contacting a fluid or tissue sample from a subject with a chimeric virus of this disclosure and detecting the binding of at least one polypeptide encoded by the virus to the antibody. A fluid sample of this method includes any biological fluid which could contain the antibody, such as cerebrospinal fluid, blood, bile plasma, serum, saliva and urine. Other possible examples of body fluids include sputum, mucus and the like.

In one example, the presence of a DENV antibody is detected in a sample from a subject utilizing a disclosed chimeric *flavivirus* in a plaque-reduction neutralization test (PRNT) or micro-focus reduction neutralization test (mFRNT). In the PRNT or mFRNT assay, a sample is contacted with a virus encoded by a chimeric *flavivirus* disclosed herein. A suitable cell culture (such as Vero, C6/36, or BHK cells) is inoculated with the virus-sample mixture to infect the cells. The cell culture is incubated under conditions sufficient to allow plaque or micro-focus formation and the number of plaques or micro-foci formed in a culture inoculated with the chimeric virus-sample mixture is compared to the number of plaques or micro-foci formed in a control culture (such as cells inoculated with virus alone). A reduction in the number of plaques or micro-foci in the cell culture inoculated with the chimeric virus-sample mixture as compared to the control culture (for example a decrease of at least 50%, 60%, 70%, 80%, 90%, 95%, or 99% compared with the control sample) indicates the presence of a DENV neutralizing antibody in the sample.

Enzyme immunoassays such as immunofluorescence assay, ELISA and immunoblotting can be readily adapted to accomplish the detection of *flavivirus* antibodies in a sample according to the methods of this disclosure. An ELISA method effective for the detection of the antibodies includes, for example: 1) bind the chimeric virus or virus particles to a substrate; 2) contact the bound chimeric virus with a fluid or tissue sample containing the antibody; 3) contact the above with a secondary antibody, which is reactive with the bound antibody, bound to a detectable moiety (for example, horseradish peroxidase enzyme or alkaline phosphatase enzyme); 4) contact the above with the substrate for the enzyme; 5) contact the above with a color reagent; and 6) observe/measure color change or development.

The detectable moiety allows for visual detection of a precipitate or a color change, visual detection by microscopy (such as a chromogenic deposit or fluorescence), or automated detection by spectrometry, radiometric measurement or the like. Examples of detectable moieties include fluorescein, fluorescein isothiocyanate, rhodamine, Cy5, and Cy3 (for fluorescence microscopy and/or the microsphere-based immunoassay), horseradish peroxidase (for either light or electron microscopy and biochemical detection), biotin-streptavidin (for light or electron microscopy) and alkaline phosphatase (for biochemical detection by color change).

Another immunologic technique that can be useful in the detection of *flavivirus* antibodies uses mAbs for detection of antibodies specifically reactive with *flavivirus* polypeptides in a competitive inhibition assay. Briefly, a sample is contacted with a chimeric *flavivirus* or virus particle of this invention which is bound to a substrate (for example, a 96-well plate). Excess sample is thoroughly washed away. A labeled (for example, enzyme-linked, fluorescent, radioactive, etc.) mAb is then contacted with any previously formed polypeptide-antibody complexes and the amount of mAb binding is measured. The amount of inhibition of mAb binding is measured relative to a control (no antibody), allowing for detection and measurement of antibody in the sample. The degree of mAb binding inhibition can be a very specific assay for detecting a particular *flavivirus* variety or strain, when based on mAb binding specificity for a particular variety or strain of *flavivirus*. mAbs can also be used for direct detection of *flavivirus* in cells by, for example, immunofluorescence assays according to standard methods.

As a further example, a micro-agglutination test can be used to detect the presence of *flavivirus* antibodies in a sample. Briefly, latex beads, red blood cells or other agglutinable particles are coated with a chimeric *flavivirus* or virus particles of this disclosure and mixed with a sample, such that antibodies in the sample that are specifically reactive with the antigen crosslink with the antigen, causing agglutination. The agglutinated antigen-antibody complexes form a precipitate, visible with the naked eye or measurable by spectrophotometer.

In yet another example, a microsphere-based immunoassay can be used to detect the presence of *flavivirus* antibodies in a sample. Briefly, microsphere beads are coated with a chimeric *flavivirus* or virus particle of this disclosure and mixed with a sample, such that antibodies in the sample that are specifically reactive with an antigen encoded by the virus bind the antigen. The bead-bound virus-antibody complexes are allowed to react with fluorescent-dye labeled anti-species antibody (such as FITC-labeled goat anti-human IgM), and are measured using a microsphere reader (such as a Luminex® instrument).

VII. Evaluation of Candidate Vaccine Efficacy

The chimeric *flaviviruses* disclosed herein may be used in methods to assess the efficacy of candidate vaccines, such as DENV vaccine candidates. A number of candidate DENV vaccines have been developed previously, such as attenuated vaccine strains (for example DEN2 PDK-53, DENT PDK-13, DEN3 PGMK-30/FRhL-3, and DEN4 PDK-48) and chimeric DENV constructs (see e.g. U.S. Pat. No. 7,094, 411). However, currently there is no ideal mouse model for evaluation of candidate DENV vaccines, because outbred immune competent mice do not succumb to wild type DENV challenge and do not generate sufficient viremia for measuring a protective effect of a candidate vaccine.

In some examples, the efficacy of candidate DENV vaccines are tested by inoculating subjects (for example, mice or non-human primates (such as rhesus monkeys)) with a candidate vaccine, followed by challenge with a virulent DENV strain. The disclosed WN/DENV chimeras are virulent and/or generate significant viremia in non-immunized mice, therefore they can be used as the challenge dose in previously inoculated subjects.

In one particular embodiment, a set of subjects (such as mice) is inoculated with a candidate DENV vaccine (for example, DENV2 PDK-53 strain). Administration of the candidate vaccine strain virus may be carried out by any suitable means, including both parenteral injection (such as intraperitoneal, subcutaneous, or intramuscular injection), by in ovo injection in birds, orally, and by topical application of the virus (typically carried in the pharmaceutical formulation) to an airway surface. Topical application of the virus to an airway surface can be carried out by intranasal administration (e.g. by use of dropper, swab, or inhaler which deposits a pharmaceutical formulation intranasally) or by inhalation administration, such as by creating respirable particles of a pharmaceutical formulation (including both solid particles and liquid particles) containing the virus as an aerosol suspension, and then causing the subject to inhale the respirable particles. In a particular example, the subjects are inoculated intraperitoneally with candidate vaccine virus in a vehicle such as phosphate buffered saline Multiple inoculations (such as boosters) may be carried out, separated by a suitable period of time, such as at least two weeks, four weeks, eight weeks, twelve weeks, or more.

Subjects that have been test vaccinated with the candidate vaccine are challenged with a virulent or lethal dose of a WN/DEN chimera disclosed herein following a suitable period of time to allow immunity based on the vaccination to develop (such as at least two weeks, four weeks, eight weeks, twelve weeks, or more). The challenge dose is administered by any suitable route including those above, and optionally is administered by the same or a different route as the vaccinating dose. Following the challenge dose, subjects are monitored for development of morbidity (such as fever, rash, vomiting, loss of appetite, rough fur, hunched back, lethargy, unbalanced or irritable movement, dehydration, weight loss, or signs of paralysis) or mortality. In addition, blood is collected from subjects after challenge for measurement of viremia levels. A decrease in viremia levels, signs of morbidity and/or mortality compared to a set of control subjects which is not inoculated with the candidate vaccine (for example, a decrease of at least 10%, 20%, 30%, 40%, 50%, 60%, 70%, 80%, 90%, 95%, or 99% in a test vaccinated population compared with a control population) indicates the effectiveness of the candidate vaccine.

The following examples are provided to illustrate certain particular features and/or embodiments. These examples should not be construed to limit the disclosure to the particular features or embodiments described.

Example 1

Construction of Chimeric Viruses

This example describes construction of chimeric West Nile/Dengue viruses including the prM and E genes from DENV in a WNV backbone. The WN/DEN2 virus was previously described in U.S. Pat. No. 8,715,689, which is incorporated herein by reference in its entirety.

Methods

Using reverse genetics, a two-plasmid infectious clone system was developed to construct the chimeric WN/DENV for all 4 serotypes of dengue virus (DENV-1 to -4). These chimeras contain a replicative vector of West Nile virus (WNV) expressing the pre-membrane (prM) and envelope (E) genes of DENV. The prM protein is an important chaperone protein for E protein processing and viral envelope assembly in cells, and a peptide located between capsid (C) and prM genes is the signal sequence (ss) for correct prM protein processing. The C(ss) is quite different between the WNV and DENV. The C(ss) length for WNV is 18 amino acids, but it is 14 amino acids for DENV. Due to the differences of the C(ss) between WNV and DENV, multiple junction strategies were investigated to obtain chimeras with acceptable growth and stability in mammalian cells.

The initial strategy for the chimera constructs was to incorporate the DENV SS (14 amino acids) to optimize the protein processing for the DENV prM in the chimeras (FIG. 1B and Table 6, type I junction). This strategy was previously described in U.S. Pat. No. 8,715,689, incorporated herein by reference. Using this approach, viable chimeric viruses for all four serotypes from transfected C6/36 cells were produced, but the WN/DENV-3 chimera replicated significantly less efficiently ($<10^4$ pfu/ml on day 8 p.i.) than the other three serotypes of chimeras in cell cultures (generally $>10^6$-$10^7$ pfu/ml on day 6-8 p.i.) or in mice.

To further optimize the WN/DENV chimeras, additional chimeric junction strategies were tested. Four additional junction sites at the C(ss) in the WN/DENV-3 chimera were tested, and infectious chimeras were recovered from three of the four new junction strategies. Two of the strategies (junction type II and III; FIGS. 1C and 1D, respectively, and Table 6) resulted in chimeras that replicated significantly better than the type I WN/DENV-3 chimera and similar to the other three serotypes of type I chimeras in cell cultures and mice. Type II junction strategy chimeras contained the 6 amino acids of the N-terminal C(ss) of WNV followed by 12 amino acids of C-terminal C(ss) of DENV-3. The Type III strategy C(ss) contained all 18 AA of C(ss) from WNV.

The engineered 5' chimeric cDNA clones (containing 5'NCR-C-prM-E) of each chimera was in vitro ligated with the 3' WNV cDNA clone (containing NS1-NS2A/2B-NS3-NS4A/4B-NS5-3'NCR) to generate full-length genomic cDNA of the chimeric virus. Chimeric viral genomic RNA was generated by in vitro transcription of the full-length cDNA, and transfected into C6/36 or Vero cells by electroporation as previous described. Chimeric viruses derived from the transfected cells were harvested on day 3-7 post transfection, and amplified by passage once in C6/36 cells to generate the master virus seeds for virus characterization. These seeds were genomic sequenced to verify their correctness of the RNA genome. Growth kinetics of the viruses in C6/36 and Vero cells were also analyzed to evaluate their replication efficiency. These chimeras replicated very well and significantly faster than the wild-type DENVs in C6/36 cells, but some of the chimeric viruses replicated poorly and/or were unstable in mammalian Vero cells.

To further improve viral growth in Vero cells, the chimeras were passaged with suboptimal growth in Vero cells up to ten times to obtain cell-adapted mutations that improved the growth and genetic stability of the chimeras in mammalian cells. Virus titrations and genomic sequencing of the chimeras after serial passages in Vero cells were conducted to identify potential mutations that enhance the chimeras' fitness and stability in mammalian cells. Specific amino acid substitutions determined to be effective in Vero cell-adaption were then engineered into the chimeric constructs by mutagenesis cloning, and the modified chimeric viruses were derived from C6/36 cells as described above. These modified chimeric viruses were analyzed for growth kinetics in Vero cells and infectivity in mice, to confirm their improved growth in mammalian cells and enhanced infectivity in mice. Genome sequences of the modified chimeras were also analyzed to confirm their genetic stability in Vero cells.

Results

WN/DENV-1: No amino acid substitutions were necessary for the WN/DENV-1 chimera with a type I junction (named WN/DENV-1; SEQ ID NOs: 11 and 12) to replicate well in both cell types, and it had acceptable genetic stability in both cell types. Therefore, the WN/DENV-1 with type I junction sites was directly used without further genetic modification. However, mutation of residue 347 of the E protein (from Gln to Leu) further improved WN/DENV-1 fitness (Table 8). This mutation evolved in a specific WN/DENV-1 virus seed amplified from Vero cells, which had a Leu substitution at E protein amino acid 106 (chimera engineered with Gly-E106-Leu substitution). The Gly-E106-Leu mutation engineered in the chimeras typically made them replicate less efficiently in Vero cells, so the E347 mutation appears more important for fitness of the WN/DENV-1 G106L mutant than the WN/DENV-1 without G106 mutation.

WN/DENV-2: Previous data showed that WN/DENV-2 with junction type I strategy replicated well in C6/36 cells, but not in Vero cells, though multiple amino acid substitutions were observed in the WN/DENV-2 during Vero cell adaption. Further mutagenesis study showed that the Asn-E203-Asp substitution alone is sufficient to enhance the chimeric virus fitness in Vero cells (named WN/DENV-2 E203; SEQ ID NOs: 13 and 14). This chimera is described in detail in U.S. Pat. No. 8,715,689. Other mutations did not seem to have significant effect on the chimera fitness, but combinations of some of those mutations may also increase the fitness of this chimera in Vero cells.

WN/DENV-3: As discussed above, using the type I junction strategy did not produce robust WN/DENV-3 chimeras in either cell type. The original WN/DENV-3 without any modification reached lower peak titer (<7 $\log_{10}$ pfu/ml) than the other three serotypes (usually 8 or 9 $\log_{10}$ pfu/ml) of chimera in C6/36 cells. This WN/DENV-3 chimera also had

TABLE 6

Organization of WN/DEN chimeras with different types of junctions

| Junction Type | 5' NCR | $C_v$ (1-105) | $C_i$ (ss) | prM (1-166) | E | NS1-5; 3'NCR |
|---|---|---|---|---|---|---|
| Type I (nt) | 1-411 | | | D1: 395-2419; D2: 397-2421; D3: 395-2413; D4: 399-2423 | | 2470-11029 |
| WN/D1 (aa) | 5'NCR | C(1-105) | D1: 101-114 | prM (1-166) | D1: 1-495 | NS1-5; 3'NCR |
| WN/D2 (aa) | | | D2: 101-114 | | D2: 1-495 | |
| WN/D3 (aa) | | | D3: 101-114 | | D3: 1-493 | |
| WN/D4 (aa) | | | D4: 100-113 | | D4: 1-495 | |
| Type II (nt) | 1-429 | | | D1: 410-2419; D2: 412-2421; D3: 410-2413; D4: 414-2423 | | 2470-11029 |
| WN/D1 (aa) | 5'NCR | C(1-111) | D1: 103-114 | prM (1-166) | D1: 1-495 | NS1-5; 3'NCR |
| WN/D2 (aa) | | | D2: 103-114 | | D2: 1-495 | |
| WN/D3 (aa) | | | D3: 103-114 | | D3: 1-493 | |
| WN/D4 (aa) | | | D4: 102-113 | | D4: 1-495 | |
| Type III (nt) | 1-429 | | | D1: 437-2419; D2: 439-2421; D3: 437-2413; D4: 441-2423 | | 2470-11029 |
| WN/D1 (aa) | 5'NCR | C(1-123) | | prM (1-166) | D1: 1-495 | NS1-5; 3'NCR |
| WN/D2 (aa) | | | | | D2: 1-495 | |
| WN/D3 (aa) | | | | | D3: 1-493 | |
| WN/D4 (aa) | | | | | D4: 1-495 | |

5'NCR, Cv (1-105), C(1-123), and NS1-5; 3'NCR are WNV sequence; Ci(ss), prM(1-166), and E are DEN sequence the lowest growth in Vero cells when compared to other serotypes of chimera. Multiple amino acid mutations evolved during attempts to adapt the virus in Vero cells (Table 7). Several versions of the WN/DENV-3 with various combinations of these mutations (e.g., C106/prM22/E395, C106/prM22/prM154, C106/prM154/E395, and C106/prM22/prM154/E395) were also engineered to improve the fitness of the chimeras. Although some beneficial effects of these mutations were observed in cell culture (virus titers increased significantly in C6/36 cell cultures, but only slightly in Vero cells), these substitutions were not sufficient to stabilize the chimeras in the Vero cells (additional mutations would continue to evolve from Vero cell culture of the chimeras). In addition, none of these modifications resulted in satisfactory chimeras that effectively infected the AG129 mice (a mouse model widely used for DENV research). AG129 mice were found to be highly susceptible to all the other serotypes of WN/DENV chimeras that were produced.

Due to the lower replication/stability in cell cultures and lack of infectivity of the WN/DENV-3 using type I junction strategy, four additional constructs with different junction strategies at the C(ss) were designed and produced. Two of these strategies resulted in improved chimeric viruses, WN/DENV-3 B (junction type II) and WN/DENV-3 C (junction type III). Chimeras from both strategies replicated well in C6/36 and Vero cells, but they were not genetically stable in Vero cells. Just one Vero-cell passage of these chimeras resulted in mutation (His to Leu) at E345 position (Table 7) in both WN/DENV-3 B (named WN/DENV-3 BE345; SEQ ID NOs: 15 and 16) and WN/DENV-3 C (named WN/DENV-3 CE345; SEQ ID NOs: 17 and 18) chimeras. Interestingly, the same E345 mutation was previously identified to be critical for Vero cell adaption of DENV-2/DENV-3 chimeras (see, U.S. Pat. No. 7,094,411).

In addition, the E347 mutation that evolved in the WN/DENV-1 E protein G106L replicated in Vero cells (described above) corresponds to the E345 position of the DENV-3 according to an amino acid alignment of all DENVs. Since the E345 mutation seemed to be very effective in fitness enhancement of various chimeric DENVs (especially with DENV-3 prM-E gene), this substitution was incorporated into final versions of the WN/DENV-3 constructs with all three junction strategies (I, II, III). For the construct with type I junction (WN/DENV-3 E345), this mutation only slightly enhanced the overall fitness of the chimera, but the chimera continued to evolve with additional mutations in Vero cells. On the other hand, incorporation of the His-E345-Leu mutation in WN/DENV-3 B and C constructs successfully stabilized the chimeric viruses replicated in Vero cells.

WN/DENV-4: A single substitution (Thr to Pro) at the C-107 residue (Table 7) was identified as being important for the WN/DENV-4 genetic stability in Vero cells. This substitution was not as critical for the viral replication or genetic stability in C6/36 cells. The Thr-C107-Pro substitution was engineered into the WN/DENV-4 chimera, named WN/DENV-4 C107 (SEQ ID NOs: 19 and 20). The C107 (position based on chimeric virus) is at C101 of the parental DENV-4 strain 1036, and it is the first DENV-4 amino acid of the C(ss) in the chimera using type I junction strategy. The C protein of DENV-4 is one amino acid shorter than the other three serotypes of DENV, and C101 of DENV-4 is aligned to C102 of the other three DENV serotypes in the amino acid sequence alignment among all DENVs. In addition to the C107 mutation, a Gly to Arg mutation at NS4A-18 (in WN part of the chimera) was also observed that may further improve the viral fitness in Vero cells. This mutation was also one of the multiple mutations observed in a WN/DENV-3 after multiple passages in Vero cells (Table 7).

TABLE 7

Mutations in chimeric WN/DEN viruses

| | | Amino Acid | | | Nucleotide | |
|---|---|---|---|---|---|---|
| Junction | DEN Type | Gene-AA position (chimera) | AA position (DV alignment) | WT-Mut | WN/DEN position | Original virus position |
| I | 3 | C-92 | WNV | Thr-Ile | C371T | WNV-371 |
| I | 3 | C-106 (ss) | 101 (D1:S, D2:S, D3:T); 100 (D4:S) | Thr-Ser | A412T | DV3-395 |
| I | 4 | C-107 (ss) | 102 (D1:V, D2:A; D3:S); 101 (D4:T) | Thr-Pro | A415C | DV4-401 |
| I | 3 | prM-22 | 22 (D1, D2, D3:S; D4:P) | Ser-Pro | T517C | DV3-500 |
| I | 3 | M-44 (prM-135) | 135 (D1:V, D2:I, D3:I, D4:L) | Ile-Thr | T857C | DV3-840 |
| I | 3 | M-63 (prM-154) | 154 (D1, D2, D3:I; D4:F) | Ile-Thr | T914C | DV3-897 |
| I | 3 | M-64 (prM-155) | 155:F | Phe-Leu | T916C | DV3-899 |
| I | 3 | E-171 | 171 (D1:S; D2:T; D3:A; D4:V) | Ala-Ile | C1463T | DV3-1446 |
| I | 2 | E-203 | 203 (D1:E; D2:N; D4:K); 201 (D3:E) | Asn-Asp | A1558G | DV2-1543 |
| I | 3 | E-309 | 311 (D1, D2, D4:E); 309 (D3:E) | Glu-Ala | A1877C | DV3-1860 |
| I | 3 | E-345 | 347 (D1:Q, D2:V, D4:V); 345 (D3:H) | His-Leu | A1985T | DV3-1968 |
| II & III | | | | | A1997T | DV3-1968 |
| I | 1 | E-347 | | Gln-Leu | A1991T | DV1-1974 |
| I | 3 | E-395 | 397 (D1, D2, D4:S); 395 (D3:S) | Ser-Ala | T2134G | DV3-2117 |
| I | 3 | E-415 | 417 (D1, D2:D, D4:E); 415 (D3:D) | Asp-Ala | A2195C | DV3-2178 |

TABLE 7-continued

Mutations in chimeric WN/DEN viruses

| Junction | DEN Type | Gene-AA position (chimera) | AA position (DV alignment) | WT-Mut | WN/DEN position | Original virus position |
|---|---|---|---|---|---|---|
| I | 3 | NS3-71 | WNV | Ser-Gly | A4783G | WNV-4822 |
| I | 3 | NS4A-18 | WNV | Gly-Arg | G6481C | WNV-6520 |
| I | 4 | | | | G6487A | |

TABLE 8

Effect of mutations on chimeric virus fitness

| DEN Type | Gene-AA position (chimera) | WT-Mut | Cell Adaptation[a] Vero | C6/36 | Notes |
|---|---|---|---|---|---|
| 3 | C-92 | Thr-Ile | nd | – | |
| 3 | C-106 (ss) | Thr-Ser | + | + | |
| 4 | C-107 (ss) | Thr-Pro | + | – | |
| 3 | prM-22 | Ser-Pro | + | – | |
| 3 | M-44 (prM-135) | Ile-Thr | nd | nd | Co-evolved with |
| 3 | M-63 (prM-154) | Ile-Thr | + | – | E395 or E415 |
| 3 | M-64 (prM-155) | Phe-Leu | + | – | |
| 3 | E-171 | Ala-Ile | + | – | |
| 2 | E-203 | Asn-Asp | + | – | |
| 3 | E-309 | Glu-Ala | + | – | |
| 3 | E-345 | His-Leu | + | – | |
| 1 | E-347 | Gln-Leu | + | – | |
| 3 | E-395 | Ser-Ala | + | – | Co-evolved with |
| 3 | E-415 | Asp-Ala | + | – | M44 + M63 or M63 |
| 3 | NS3-71 | Ser-Gly | nd | nd | |
| 3 | NS4A-18 | Gly-Arg | nd | – | |
| 4 | | | | | |

[a]Evidence of cell adaption include increased replication efficiency (growth kinetics or plaque size), overall virus yield, and genetic stability of the chimera replicated from cell cultures.
"+" indicates the mutation demonstrated at least one of the criteria.
"–" indicates the mutation is not required for cell adaption.
"Nd" means not determined; these mutations co-evolved with other mutations and their contributions to the fitness have not been determined.

Example 2

Growth Characteristics of WN/DENV Chimeras in Cell Culture

This example describes the growth characteristics of WN/DENV chimeras in Vero and C6/36 cell cultures.

Chimeras described in Example 1 (WN/DENV-1, WN/DENV-2 E203, WN/DENV-3 CE345, and WN/DENV-4 C107) were tested for their ability to replicate in Vero cells and C6/36 cells. These chimeras replicated more efficiently than the wild-type DENVs in both C6/36 and Vero cells, as shown in the early days of viral growth in cells (FIGS. 2A and 2B). On the second day post-infection (d.p.i.) of Vero cells, titers of WN/DENV chimeras were about 2-3 $\log_{10}$ higher (p<0.05) than the DENVs (FIG. 2A). In early time points of C6/36 cell cultures, chimeras also showed significantly higher titers (p<0.05) than the DENVs (FIG. 2B). The growth curves of the chimeras plateaued about 4-5 days earlier than those of DENVs in Vero cells, and 2-3 days earlier in C6/36 cells (Table 9). In addition, the chimeras produced higher yield than the DENVs in C6/36 cells (Table 9).

TABLE 9

Growth of chimeras and DENV in C6/36 and Vero cells

| | C6/36 Cells | | Vero Cells | |
|---|---|---|---|---|
| | Plateau days | $\log_{10}$ pfu/ml | Plateau days | $\log_{10}$ pfu/ml |
| WNV NY99 | 4-8 | 9.5-10.0 | 2-4 | 8.5-9.5 |
| DENY-1 | 6-10 | 7.0-8.0 | 6-10 | 6.0-7.5 |
| WN/DENY-1 | 5-8 | 8.5-9.5 | 2-5 | 6.5-7.5 |
| DENY-2 | 6-10 | 7.0-8.5 | 8-12 | 5.5-7.0 |
| WN/DENY-2 E203 | 5-8 | 8.5-9.5 | 3-5 | 6.5-7.5 |
| DENY-3 | 8-10 | 6.5-7.5 | 6-10 | 5.5-6.5 |
| WN/DENY-3 CE345 | 5-8 | 8.5-9.5 | 2-4 | 6.5-7.5 |
| DENV-4 | 6-10 | 7.0-8.5 | 6-10 | 6.0-7.5 |
| WN/DENV-4 C107 | 5-8 | 8.5-9.5 | 2-4 | 6.5-7.5 |

Example 3

Determination of WN/DENV Chimera Virulence in Mice and Their Use as Lethal Challenge Virus to Evaluate DENV Vaccine This example describes the virulence of the WN/DENV chimeras in mice and use of the chimeras as a lethal challenge to evaluate efficacy of candidate DENV vaccines.

The virulence of the chimeras was characterized in 3-week old CD-1 mice and 12-week old AG129 mice (Table 10). The 50% lethal dose ($LD_{50}$) was determined for WNV, the WN/DENV chimers, and a mixture of DENV1-4 by intracerebral (i.c.) or intraperitoneal (i.p.) administration. Overall, the WN/DEN chimeras were more infectious and virulent than the wild-type DENVs in mice.

TABLE 10

Chimera virulence in mice

| | $LD_{50}$ ($\log_{10}$ pfu) | | |
|---|---|---|---|
| | CD1 (i.c.) 3-week old | CD-1 (i.p.) 3-week old | AG129 (i.p.) 12-13 week old |
| WNV NY99 | 0.6 | 1.7 | 0.3 |
| WN/DENV-1 | 2.6 | >7.0 | <1.0 |
| WN/DENV-2 E203 | >7.0 | >8.0 | 1.0-2.0 |
| WN/DENV-3 CE345 | 4.25 | >6.0 | 4.50 |
| WN/DENV-4 C107 | 5.2 | >7.0 | 2.0-3.0 |
| DENV (1-4) | >5.0 | >6.0 | >6.0 |

The chimeras were evaluated for use as lethal viruses for AG129 mouse challenge in a DENV vaccine efficacy study. Groups of 3-4-week-old AG129 mice (n=32/group) were vaccinated with a single (prime only on day 0) or double (prime on day 0 and boost on day 30) dose of the tetraDEN-Vax (tetravalent live-attenuated recombinant DEN vaccine described in U.S. Pat. No. 7,094,411). Placebo vaccine group received PBS only on both days. Each group of mice were then separated to 4 subgroups (n=8/subgroup), and each subgroup was challenged with a $10^7$ pfu of a single serotype of WN/DENV chimera on day 120 (3 months after $2^{nd}$ dose). Mice were monitored for morbidity after challenge, and mice with signs of morbidity, such as rough fur, hunched back, lethargy, unbalanced or irritable movement, dehydration, over 10% weight loss, or paralysis were euthanized. Protective efficacy of the vaccine was evaluated by comparing survival ratios of the vaccinated groups to the placebo groups. Mouse sera were collected on days 28, 60, 90, 118, and 148. Sera from each subgroup of mice were tested for neutralizing antibodies against their respective serotype by a micro-focus reduction neutralization test (mFRNT; Table 11).

Results showed that all four serotypes of WN/DEN chimeras were lethal to naïve mice (placebo groups), and mice vaccinated with 1 or 2 doses of the live-attenuated tetravalent vaccine were fully protected against each serotype of WN/DEN virus challenge (FIG. 3A-3D). The chimeras were also evaluated in a challenge of older AG129 mice (up to 27-week old), and $10^7$ pfu of each WN/DEN chimera was sufficient to cause 100% morbidity within 3-7 days in this age group. Because the chimeras were uniformly lethal for a wide age range of AG129 mice (3- to 27-weeks old) by the most convenient intraperitoneal injection, causing morbidity/mortality within a week, they can be instrumental in establishing easy, flexible, and long-term AG129 efficacy models for vaccine or therapeutic development against all four DENV serotypes.

Puerto Rico. Dengue-naïve serum samples (n=4) were collected from individuals living in non-endemic regions.

Two-fold serially diluted human serum samples were pre-incubated with specific amount of virus for 60 min at 37° C. or overnight at 4° C. Serum/virus mix was inoculated onto Vero monolayers for 90 minutes adsorption, and the cells were overlaid with medium containing 0.8% agarose (for plaque-reduction neutralization test (PRNT)) or 1% carboxymethylcellulose (for micro-focus reduction neutralization test (mFRNT)). Plates were incubated at 37° C. for 1-7 days, depending on the time required for plaque or micro-foci formation. For PRNT, the plates were overlaid with another agarose overlay containing 1.5% neutral red to visualize plaques, and plaques were counted the following 1-3 days. Plaques could be counted on day 3-4 for the chimeras, and on day 7-10 for the wt DENVs. In mFRNT, plates were washed with PBS to remove overlay and fixed with acetone for 1 hr at −20° C. Micro-foci were immunostained with serotype specific primary Ab, followed by HRP-conjugated secondary Ab and precipitating substrate. Micro-spots could be stained for counting at 24 hrs post infection of the chimeras, and at 48 hrs post infection of wt DENVs.

Because the WN/DENV chimeras replicated faster, they produced visible viral plaques and micro-foci much earlier than the wt DENVs. In addition, plaques and immune-foci produced from the chimeras were more uniform and better defined than those from the wt DENVs (FIGS. 4, 5A and 5B). Therefore, use of the chimeras in neutralization assay could potentially enhance the efficiency (shorter duration) and accuracy (more accurate plaque or micro-foci number measurement) of the assay.

TABLE 11

Neutralization antibody titers from TetraDENVax efficiacy study

| Against | Vaccine | Day 28 | | Day 118 | | Day 120 Chimera | Day 148 | |
|---|---|---|---|---|---|---|---|---|
| Serotype | Dose[a] | GMT[b] | Range | GMT[b] | Range | Challenge | GMT[b] | Range |
| DENV-1 | 0 | <20 | <20 | <20 | <20 | WN/ | NA[c] | NA |
| | 1 | 54 | 20-160 | 226 | 40-1280 | DENV1 | 12177 | 5120-40960 |
| | 2 | 98 | 40-160 | 381 | 160-1280 | | 7896 | 2560-40960 |
| DENV-2 | 0 | <20 | <20 | <20 | <20 | WN/ | NA | NA |
| | 1 | 970 | 320-5120 | 5120 | 1280-10240 | DENV2 | 17222 | 1280-40960 |
| | 2 | 905 | 640-1280 | 2560 | 2560 | | 12483 | 1280-20480 |
| DENV-3 | 0 | <20 | <20 | <20 | <20 | WN/ | NA | NA |
| | 1 | 195 | 160-320 | 320 | 80-640 | DENV3 | 9390 | 640-40960 |
| | 2 | 320 | 160-320 | 1174 | 320-2560 | | 18780 | 2560-40960 |
| DENV-4 | 0 | <20 | <20 | <20 | <20 | WN/ | NA | NA |
| | 1 | 59 | 40-80 | 320 | 160-640 | DENV4 | 5120 | 2560-10240 |
| | 2 | 52 | 20-160 | 415 | 320-640 | | 2874 | 1280-10240 |

[a]Vaccination Dose: 0 = PBS on day 0 and day 30; 1 = TetraDENVax on day 0 only; 2 = TetraDENVax on day 0 and day 30
[b]Geometric Mean Titer represents 70% mFRNT cutoff
[c]NA: Not applicable. No mice survived for serum collection.

Example 4

Neutralization Assays

This example describes assessment of neutralizing antibody response to DENV infection using WN/DENV chimeras.

Neutralization assays of a panel of human clinical sera from patients exposed to single or multiple serotype of DENV were conducted against WN/DEN chimeras and wt DENVs. A reference panel of characterized human sera (n=18) was obtained from Walter Reed Army Institute of Research. Clinical human serum samples (n=12) were obtained from Dengue Branch/DVBD/CDC, San Juan, A reduction in the number of plaques or micro-foci in the cells inoculated with the virus-serum mixture as compared to the cells infected with virus alone indicates the presence of a neutralizing antibody in the serum. The neutralizing antibody titer is identified as the highest serum dilution that reduces the number of virus plaques in the test by 50%, 70% or 90% (Tables 12 and 13). The test results showed that neutralization titers against the WN/DEN chimeras generally agreed with the titers against wt DENVs (within 4-fold of variation) in the majority of the samples tested (Table 12). No cross-reactivity was seen to Japanese encephalitis virus (JEV)-positive sera. Mono-serotypic sera did not show reactivity to the three other DENV serotypes.

TABLE 12

Evaluation of WN/DENVs in mFRNT with human reference panel mFRNT Titers[b]

| ID | Sero-reactivity | Strength[a] | DENV1 | WN/D1 | DENV2 | WN/D2 | DENV3 | WN/D3 | DENV4 | WN/D4 |
|---|---|---|---|---|---|---|---|---|---|---|
| 1 | DENV1 | H | 160 | 320 | <10 | 10 | <10 | <10 | <10 | <10 |
| 2 | | M | 80 | 160 | <10 | <10 | <10 | <10 | <10 | <10 |
| 3 | | L | 20 | 40 | <10 | <10 | <10 | <10 | <10 | <10 |
| 4 | DENV2 | H | <10 | <10 | 40 | 80 | <10 | <10 | <10 | <10 |
| 5 | | M | <10 | <10 | 80 | 80 | <10 | <10 | <10 | <10 |
| 6 | | L | <10 | <10 | 20 | 20 | <10 | <10 | <10 | <10 |
| 7 | DENV3 | H | <10 | <10 | <10 | <10 | 160 | 160 | <10 | <10 |
| 8 | | M | <10 | <10 | <10 | <10 | 80 | 80 | <10 | <10 |
| 9 | | L | <10 | <10 | <10 | <10 | <10 | <10 | <10 | <10 |
| 10 | DENV4 | H | <10 | <10 | <10 | <10 | <10 | <10 | 160 | 160 |
| 11 | | M | <10 | <10 | <10 | <10 | <10 | 10 | 160 | 160 |
| 12 | | L | <10 | <10 | <10 | <10 | <10 | <10 | 40 | 40 |
| 13 | JEV | H | <10 | <10 | <10 | <10 | <10 | <10 | <10 | <10 |
| 14 | | M | <10 | <10 | <10 | <10 | <10 | <10 | <10 | <10 |
| 15 | | L | <10 | <10 | <10 | <10 | <10 | <10 | <10 | <10 |
| 16 | Flavi-Naive | | <10 | <10 | <10 | <10 | <10 | <10 | <10 | <10 |
| 17 | | | <10 | <10 | <10 | <10 | <10 | <10 | <10 | <10 |
| 18 | | | 10 | 10 | <10 | <10 | <10 | <10 | <10 | <10 |

[a]Strength of neutralization: H = high, M = medium, L = low
[b]Titers are 90% neutralization of virus infection

TABLE 13

Evaluation of WN/DENVs in mFRNT using human clinical serum samples mFRNT Titers[b]

| ID | Sero-reactivity | DENV1 | WN/D1 | DENV2 | WN/D2 | DENV3 | WN/D3 | DENV4 | WN/D4 |
|---|---|---|---|---|---|---|---|---|---|
| DB-1 | Polytypic | 10,240 | 10,240 | 2560 | 5120 | 163,840 | 163,840 | 320 | 1280 |
| DB-2 | | 5120 | 10,240 | 10,240 | 20,480 | 2560 | 5120 | 2560 | 5120 |
| DB-3 | | 10,240 | 20,480 | 5120 | 5120 | 40,960 | 40,960 | 320 | 1280 |
| DB-4 | | 20,480 | 20,480 | 2560 | 5120 | 163,840 | 81,920 | 1280 | 1280 |
| DB-5 | | 5120 | 5120 | 5120 | 10,240 | 10,240 | 20,480 | 640 | 1280 |
| DB-6 | | 5120 | 10,240 | 5120 | 10,240 | 10,240 | 5120 | 640 | 1280 |
| DB-7 | | 1280 | 1280 | <80 | <80 | <80 | <80 | <80 | <80 |
| DB-8 | | 40,960 | 81,920 | 5120 | 10,240 | 10,240 | 10,240 | 640 | 2560 |
| DB-9 | | 20,480 | 20,480 | 5120 | 20,480 | 10,240 | 10,240 | 640 | 2560 |
| DB-10 | | <80 | 80 | 640 | 640 | <80 | <80 | <80 | <80 |
| DB-11 | | 40,960 | 40,960 | 5120 | 5120 | 10,240 | 10,240 | 2560 | 5120 |
| DB-12 | | 10,240 | 20,480 | 10,240 | 20,480 | 2560 | 10,240 | 1280 | 5120 |
| NHS1 | DEN-Naive | <10 | <10 | <10 | <10 | <10 | <10 | <10 | <10 |
| NHS2 | | <10 | <10 | <10 | <10 | <10 | <10 | <10 | <10 |
| NHS3 | | <10 | <10 | <10 | <10 | <10 | <10 | <10 | <10 |
| NHS4 | | <10 | <10 | <10 | <10 | <10 | <10 | <10 | <10 |

[a]Titers are 90% neutraization of virus infection. Except for DENV-native samples, most of the clinical samples were collected from patients exposed to multiple DENV serotypes.

Example 5

Inactivation of WN/DENV Chimeras

This example describes concentration/purification of WN/DENV chimeras and evaluation and optimization of methods for inactivation of WN/DENV chimeras.

Concentration/Purification

Several methods of concentration and purification of the WN/DENV chimeras described were tested. Viruses were cultured in C6/36 cells with serum-free culture medium at 28° C. for 10 or more days. On day 5, culture medium was removed and replaced with fresh medium. From day 6 to 10 (or more), each day the culture supernatant was collected to harvest the virus, and cells were refed with fresh medium for next day's harvest. Harvested supernatant was clarified from the cell debris by centrifugation at about 15,000×g for 20 minutes at 4° C. before purification.

The first method was density-gradient centrifugation, which is based on a well-established classical method to purify *flaviviruses*. Using this method the end products are highly purified virus particles, but the yield of the viruses is typically very low (typically <5%) for WT DENVs. The method is time-consuming, difficult, and not ideally suitable for large scale virus preparation. Viruses were first concentrated through a filtration system (Amicon Ultra Centrifugal Filter Unit, Centricon-70, or Tangential Flow Filtration system, with MWCO=50-100 kDa membrane) or PEG8000 precipitation, and then ultracentrifuged through a 30% glycerol-45% Potassium tartrate gradient at 260,000×g over 12 hrs one time or twice (first for 3-4 hrs, collect band and over second gradient for over 12 hrs). With the fast-growth WN/DEN chimeras described herein, that reached significantly higher titers than the wild-type DENVs, overall 50-100 fold higher amounts of the chimeras were obtained than that of wild-type DENVs in a single lab-scale purification batch using density-gradient centrifugation.

Glycerol-cushion centrifugation was also tested. The concentrated viruses were ultracentrifuged through a 30% glycerol cushion at 260,000×g for 2-3 hours. The purity of the end product was less than that produced with density-gradient centrifugation, but the method was less time-consuming, easy, and the end yield was much higher (25-60%).

Finally, Cellufine® sulfate chromatography medium was used to purify the WN/DENV chimeras. Cellufine® sulfate has high affinity for wide range of viruses, including *flaviviruses*. Virus sample was adjusted to 1-20 mg/ml in 0.01 M sodium phosphate buffer pH 7.5 or 0.5 M Tris-HCl pH8.5 with 0-0.1 M NaCl (adsorption buffer) before adsorbed onto a Cellufine® sulfate column. The column was washed with 5-10 column volumes of the adsorption buffer, and sample was then eluted with elution buffer (e.g. 0.5 M Tris-HCl with 0.2-1.0 M NaCl). This method was easy and more suitable for large scale preparation, but the results showed that the end product still contained significantly more cellular proteins than the preparation obtained with glycerol-cushion centrifugation. Further optimization by elution of sample with various gradients of ionic salt may improve the purity of the product. Also, this method could be incorporated as part of the procedure in other methods to further purify the virus. For example, to obtain higher purity, this procedure could be added before or after glycerol cushion centrifugation.

Virus Inactivation:

Several methods were tested for inactivation of the chimeric WN/DENV chimeras. The purified chimeric virus (typically purified with glycerol cushion centrifugation) was inactivated by UV 254 nm radiation at different power levels for various durations on a cold pack. Inactivated samples were titrated for infectious titer and dengue antigenic activity. UV conditions that resulted in total virus inactivation and retained the highest dengue antigen activity were further optimized (Table 14). Conditions that worked well with small sample size (0.2 ml) at high titer were identified (670 µW/cm$^2$ for 15 min or 350 µW/cm$^2$ for 45 min). For larger sample sizes (2.4-3.7 ml), longer treatment (>45 min) at 680 µW/cm$^2$ was required for full inactivation.

TABLE 14

UV-254 nm inactivation of WN/DEN4 C107

| µW/cm$^2$ | Time (min) | pfu/ml | ELISA Activity |
|---|---|---|---|
| Sample size: 0.2 ml in microfuge tube | | | |
| Untreated | NA | 1.1E+10 | 100% |
| 670-685 | 10 | 20 | 50% |
| | 15 | <20 | 25-50% |
| | 20 | <20 | 50% |
| | 30 | <20 | 50% |
| | 40 | <20 | 50% |
| | 60 | <20 | 25% |
| | 75 | <20 | 13% |
| 350 | 15 | 80 | 100% |
| | 25 | 60 | 50% |
| | 35 | 200 | 100% |
| | 45 | <20 | 100% |
| | 55 | <20 | 100% |

TABLE 14-continued

UV-254 nm inactivation of WN/DEN4 C107

| µW/cm$^2$ | Time (min) | pfu/ml | ELISA Activity |
|---|---|---|---|
| Samplesize: 2.4-3.7 ml in Falcon tube | | | |
| Untreated | NA | 1.5E+10 | 100% |
| 680 | 20 | 2.6E+05 | 100% |
| | 30 | 580 | 100% |
| | 45 | 40 | 100% |

It was also determined that WN/DENVs (up to 4×10$^9$ pfu/ml) were efficiently inactivated by 0.005% Sarkosyl at 37° C. for 1 hr, while still retaining the viral antigenic activity measured by ELISA (Table 15). Higher minimum concentration (≥0.1%) of Sarkosyl was required to inactivate samples with higher virus concentration. At concentration of 0.1% or higher, Sarkosyl is toxic to the cells. Either ultracentrifuge filters (e.g., Amicon) or detergent-out kits (e.g., Millipore) can be used to remove extra Sarkosyl from the inactivated viruses to reduce the sample toxicity to cells.

TABLE 15

Sarkosyl inactivation of WN/DEN2 at 37° C. for 1 hour

| Sarkosyl Concentration | Virus titer (pfu/ml) | ELISA activity |
|---|---|---|
| Untreated | 4.00E+09 | 100% |
| 0.0005% | 4.00E+06 | not done |
| 0.005% | <10 | ≥40% |
| 0.05% | <10 | 100% |
| 0.10% | toxic* | 100% |
| 0.20% | toxic* | 100% |
| 0.40% | toxic | 100% |
| Untreated | 1.20E+11 | 100% |
| 0.025% | 310 | 100% |
| 0.05% | 10 | 100% |
| 0.10% | toxic* | 100% |
| 0.20% | toxic* | 100% |

*The concentration of sarkosyl in the sample is toxic to cells during titration.

Preliminary results showed that β-propiolactone (BPL) and hydrogen peroxide also effectively inactivated the chimeric viruses, but they also significantly decreased the viral antigenic activity. No infectivity was measurable after treatment with 3% of BPL for 48 hrs at 4° C., or with 0.1% of H$_2$O$_2$ at room temperature for 2 hrs. However, the inactivation resulted in over 95% decreasing of the viral antigenic activity measured by ELISA.

Example 6

Evaluation of Inactivated WN/DENV Chimeras in Mice

This example describes methods for evaluating virulence and immunogenicity of inactivated WN/DENV chimeras in mice. Similar methods can be used in other subjects, such as non-human primates or humans.

WN/DENV chimeras described in Example 1 are purified and inactivated by the methods described in Example 5. Groups of 3-4-week-old AG129 mice are administered 1-50 µg of a single serotype of inactivated WN/DENV chimera on day 0 and day 30. Mice are monitored for morbidity, and mice with signs of morbidity, such as rough fur, hunched back, lethargy, unbalanced or irritable movement, dehydration, over 10% weight loss, or paralysis are euthanized. Effective inactivation of the WN/DENV chimera is evaluated by virus titration in cell culture and by survival of the immunized mice. Mouse sera are collected periodically (e.g., on days 28, 60, 90, 118, and/or 148, or other suitable days based on the particular protocol used). Sera from each subgroup of mice are tested for antigenic activity by ELISA or for neutralizing antibodies against their respective serotype by a micro-focus reduction neutralization test. Inactivation conditions that in lack of morbidity and induce highest levels of anti-DENV neutralizing antibodies are selected for use as an inactivated vaccine. Immunized mice are optionally challenged with lethal dose of live WN/DENV on day 60 to determine the protective efficacy of the two doses of each serotype of inactivated vaccine.

Example 7

Use of WN/DENV Chimeras as an Inactivated DENV Vaccine

This example describes methods for the efficacy evaluation of a combined DENV vaccination strategy in the AG129 mouse model. This combined vaccination strategy utilizes two doses of vaccine. One dose contains a tetravalent live-attenuated (LA) recombinant DENV vaccine (see U.S. Pat. No. 7,094,411) and the other contains the inactivated (IA) vaccine made with the WN/DEN chimeras described herein. Inactivation conditions are as described in Examples 5 and 6. Similar methods can be used in other subjects, such as non-human primates or humans.

To fully evaluate the potential of the IA chimera vaccine candidates, the following combinations are tested: 1) prime and boost with LA vaccine (2-dose LA vaccine control; LA/LA); 2) prime and boost with IA vaccine (2-dose IA control; IA/IA); 3) prime with LA and boost with IA vaccine (LA/IA); 4) prime with IA and boost with LA vaccine (IA/LA). Groups of 3-4-week old mice are inoculated intraperitoneally with 100 μL of PBS containing LA tetravalent vaccine ($10^3$ to $10^5$ pfu for each serotype) or IA WN/DEN chimeras ranging from 0.1 to 100 μg of each inactivated virus on day 0. The second dose, either LA or IA as described above, is injected on day 30 or 60. A group of mice are injected with PBS only on both days as the naïve control group.

On day 90 or 120, mice are challenged with a lethal dose of the live WN/DENV chimeras. These live WN/DEN chimeras have been established as lethal challenge viruses (at $10^7$ pfu each) for AG129 mice in a vaccine efficacy model (see Example 3). Challenged mice are monitored daily for 3-4 weeks and mice showing signs of illness are euthanized. Blood is collected on days 28, 58, 88, 118 from the animals for immunogenicity analysis. Mice surviving the lethal challenge will be bled at the end of the experiment. Serum samples from the collected blood are heat-inactivated at 56° C. for 30 minutes and antibodies in the serum are determined by ELISA and/or neutralization test (for example as described in Example 4). The four vaccination strategies (LA/LA, IA/IA, LA/IA, and IA/LA) are compared to develop an optimized vaccination strategy that affords up to 100% protection from lethal challenge and provides most balanced neutralizing antibody responses to all four DENV serotypes.

Further mouse studies are conducted to determine whether a single IA chimera serotype or combinations of 2-3 IA chimera serotypes are more effective as the boost vaccine to achieve balanced immunity against all 4 serotypes of DENVs. For example, tetravalent live-attenuated vaccine may result in higher antibody responses to DEN1 and DEN2, and lower responses to DEN3 and DEN4. An IA boost dose containing only DEN3 and DEN4 serotypes of WN/DEN chimera could be effective to boost the antibody responses to these two serotypes and result in more balanced antibody responses to all four serotypes than the IA boost dose containing all four serotypes of chimeras.

In view of the many possible embodiments to which the principles of the disclosure may be applied, it should be recognized that the illustrated embodiments are only examples and should not be taken as limiting the scope of the invention. Rather, the scope of the invention is defined by the following claims. I therefore claim as my invention all that comes within the scope and spirit of these claims.

SEQUENCE LISTING (23 sequences)

SEQ ID NO: 1 - DNA, 11029 bp, West Nile virus
  CDS (97)..(10398)
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagctcaaaacaaaagaaaagaggaggaaagaccggaattgcagtcatgattggcctgatcgccagcgtaggagcagttaccctctctaacttccaagggaaggtgatgatgacggtaaatgctactgacgtcacagatgtcatcacgattccaacagctgctggaaagaacctatgcattgtcagagcaatggatgtgggatacatgtgcgatgatactatcacttatgaatgcccagtgctgtcggctggtaatgatccagaagacatcgactgttggtgcacaaagtcagcagtctacgtcaggtatggaagatgcaccaagacacgccactcaagacgcagtcggaggtcactgacagtgcagacacacggagaaagcactctagcgaacaagaagggggcttggatggacagcaccaaggccacaaggtatttggtaaaaacagaatcatggatcttgaggaaccctggatatgccctggtggcagccgtcattggttggatgcttgggagcaacaccatgcagagagttgtgtttgtcgtgctattgcttttggtggccccagcttacagcttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtacgaagtggccatttttgtccatggaccaactactgtggagtcgcacggaaattactccacacaggttggagccactcaggcagggagattcagcatcactcctgcggcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccacacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagctgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaagcctttacaaccaccctcaaaggagcgcagagactagccgctctaggagacacagcttgggactttggatcagttggaggggtgttcacctcagttgggaaggctgtccatcaagtgttcggaggagcattccgctcactgttcggaggcatgtcctggataacgcaaggattgctgggggctctcctgttgtggatgggcatcaatgctcgtgataggtccatagctctcacgtttctcgcagttggaggagttctgctcttcctctccgtgaacgtgcacgctgacactgggtgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 2 - protein, 3433 aa, West Nile virus
MSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGKTGIAVMIGLIASVGAVTLSNFQGKVMMTVNATDVTDVITIPTAAGKNLCIVRAMDVGYMCDDTITYECPVLSAGNDPEDIDCWCTKSAVYVRYGRCTKTRHSRRSRRSLTVQTHGESTLANKKGAWMDSTKATRYLVKTESWILRNPGYALVAAVIGWMLGSNTMQRVVFVVLLLLVAPAYSFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGPTTVESHGNYSTQVGATQAGRFSITPAAPSYTLKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGKAFTTTLKGAQRLAALGDTAWDFGSVGGVFTSVGKAVHQVFGGAFRSLFGGMSWITQGLLGALLLWMGINARDRSIALTFLAVGGVLLFLSVNVHADTGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 3 - DNA, 10735 bp, Dengue virus type 1
  CDS (95)..(10273)
agttgttagtctacgtggaccgacaagaacagtttcgaatcggaagcttgcttaacgtagttctaacagttttttattagagagcagatctctgatgatcaaccaacgaaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcttaagatttctagccatacccccaacagcaggaattttggctagatggggctcattcaagaagaatggagcgattaaagtgttacggggtttcaagagagaaatctcaaacatgctaaacataatgaacaggaggaaaagatccgtgaccatgctccttatgctgctgcccacagccctggcgttccatctgacgacacgagggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggtttctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagttggcatggtcacactgtacctaggagtcatggttcaggcagattcgggatgtgtaatcaactggaaaggcagagaacttaaatgtggaagcggcatttttgtcactaatgaagttcacacttggacagagcaatacaaattccaggctgactcccccaagagactatcagcagccattgggaaggcatgggaggagggtgtgtgtggaatccgatcagccactcgtctcgagaacatcatgtggaaacaaatatcaaatgaattgaaccacatcctacttgaaaatgacatgaaatttacagtggtcgtgggagatgttagtggaatcttggcccaagggaaaaaaatgattaggccacaacccatggaacacaaatactcgtggaaaagctggggaaaagccaaaatcataggagcggatgtacagaacaccaccttcatcatcgacggcccaaacaccccagaatgccctgacaatcaaagagcatggaatatttgggaagtagaggactatggatttgggattttcacgacaaacatatggttgaaattgcgtgactcctacacccaagtatgtgaccaccggctgatgtcagctgccattaaggacagcaaggcagtccatgctgacatggggtactggatagaaagtgaaaagaacgagacatggaagttggcgagagcctcctttatagaagttaagacatgcatctggccaaaatcccacactctatggagcaatggagttctggaaagtgaaatgataattccaaagatatatggaggaccaatatctcagcacaactacagaccaggatatttcacacaaacagcagggccgtggcacctaggcaagttggaactagatttcgatttttgtgaaggtaccacagttgttgtggatgaacattgtggaaatcgaggaccatctctcagaaccacaacagtcacaggaaagataatccatgaatggtgctgcagatcttgtacgctaccccccctacgtttcaaaggggaagacgggtgttggtacggcatggaaatcagaccagtgaaggacaaggaagagaacctggtcaagtcaatggtctctgcagggtcaggagaagtggacagcttttcactaggactgctatgcatatcaataatgattgaagaagtgatgagatccagatggagcaaaaaaatgctgatgactggaacactggctgtgttcctccttcttataatgggacaattgacatggagtgatctgatcaggttatgtattatggttggagccaacgcttcagacaagatggggatgggaacaacgtacctagctttaatggccactttcaaaatgagaccaatgttcgccgtcgggctattatttcgcagactaacatctagagaagttcttcttcttacaattggcttgagcctggtggcatccgtggagctaccaagttccctagaggagctgggggatggacttgcaataggcatcatgatgttgaaattattgactgattttcagtcacaccagctatgggctactctgctatccttgacatttattaaaacaactttttcattgcactatgcatggaagacaatggctatggtactgtcaattgtatctctcttccctttatgcctgtccacgacctctcaaaaaacaacatggcttccggtgctgttgggatctcttggatgcaaaccactacccatgtttcttataacagaaaacaaaatctggggaaggaagagttggcccctcaatgaaggaattatggctgttggaatagttagtattctactaagttcacttttaaaaaatgatgtgccgctagccggcccattaatagctggaggcatgctaatagcatgttatgtcatatccggaagctcagctgatttatcactggagaaagcggctgaggtctcctgggaggaagaagcagaacactcaggcgcctcacacaacatactagtagaggttcaagatgatggaaccatgaagataaaagatgaagagagagatgacacgctcaccattctccttaaagcaactctgctggcagtctcaggggtgtacccaatgtcaataccagcgaccctttttgtgtggtatttttggcagaaaaagaaacagagatcaggagtgctatgggacacacccagccccccagaagtggaaagagcagttcttgatgatggcatctatagaattttgcaaagaggactgttgggcaggtcccaagtaggagtaggagttttccaagaaggcgtgttccacacaatgtggcacgtcactaggggagctgtcctcatgtatcaaggaaaaaggctggaaccaagctgggccagtgtcaaaaaagacttgatctcatatggaggaggttggaggtttcaaggatcctggaacacgggagaagaagtacaggtgattgctgttgaaccgggaaaaaaccccaaaaatgtacaaacaacgccgggtaccttcaagacccctgaaggcgaagttggagccatagccttagactttaaacctggcacatctggatctcccatcgtaaacagagagggaaaaatagtaggtctttatggaaatggagtggtgacaacaagcggaacttacgttagtgccatagctcaagctaaggcatcacaagaagggcctctaccagagattgaggacgaggtgtttaggaaaagaaacttaacaataatggacctacatccaggatcgggaaaaacaagaagataccttccagccatagtccgtgaggccataaaaaggaagctgcgcacgctaatcctagctcccacaagagttgtcgcttctgaaatggcagaggcactcaagggagtgccaataaggtatcagacaacagcagtgaagagtgaacacacaggaaaggagatagttgaccttatgtgccacgccactttcaccatgcgcctcctgtctcccgtgagagttcccaattataacatgattatcatggatgaagcacacttcaccgatccagccagcatagcagccagagggtacatctcaacccgagtgggtatgggtgaagcagctgcgatctttatgacagccactcccccaggatcggtggaggcctttccacagagcaatgcaattatccaagatgaggaaagagacattcctgagagatcatggaactcaggctatgactggatcactgattttccaggtaaaacagtctggtttgttccaagcatcaaatcaggaaatgacattgccaactgtttaagaaaaaacgggaaacgggtgatccaattgagcagaaaaacctttgacactgagtaccagaaaacaaaaaacaacgactgggactatgtcgtcacaacagacatttccgaaatgggagcaaatttccgggccgacagggtaatagacccaaggcggtgtctgaaaccggtaatactaaaagatggtccagagcgcgtcattctagccggaccgatgccagtgactgtggccagtgccgcccagaggagaggaagaattggaaggaaccaaaacaaggaaggtgatcagtatatttacatgggacagcctttaaacaatgatgaggaccacgctcattggacagaagcaaagatgctccttgacaatataaacacaccagaagggattatcccagccctctatgagccggagagagaaaagagtgcagctatagacggggaatacagactgcggggtgaagcaaggaaaacgttcgtggagctcatgagaagaggggatctaccagtctggctatcctacaaagttgcctcagaaggcttccagtactccgacagaaggtggtgcttcgatggggaaaggaacaaccaggtgttggaggagaacatggacgtggagatctggacaaaagaaggagaaagaaagaaactacgacctcgctggttggacgccagaacatactctgacccactggctctgcgcgagtttaaagagtttgcagcaggaagaagaagcgtctcaggtgacctaatattagaaatagggaaacttccacaacatttgacgcaaagggcccagaatgctttggacaacttggtcatgttgcacaattccgaacaaggaggaaaagcctatagacatgctatggaagaactgccagacacaatagaaacgttgatgctcctagccttgatagctgtgttgactggtggagtgacgctgttcttcctatcaggaagaggtctaggaaaaacatctatcggcttactctgcgtgatggcctcaagcgcactgttatggatggccagtgtggagccccattggatagcggcctccatcatactggagttctttctgatggtactgcttattccagagccagacagacagcgcactccacaggacaaccagctagcatatgtggtgataggtctgttattcatgatattgacagtggcagccaatgagatgggattattggaaaccacaaagaaagacctggggattggccatgtagctgctgaaaaccaccaccatgctacaatgctggacgtagacctacatccagcttcagcctggaccctctatgcagtggccacaacaatcatcactcctatgatgagacacacaattgaaaacacaacggcaaatatttccctgacagccatcgcaaaccaagcagctatattgatgggacttgacaagggatggccaatatcgaagatggacataggagttccacttctcgccttggggtgctattcccaagtgaatccgctgacactgatagcggcagtattgatgctagtagctcattacgccataattggacctggactgcaagcaaaagctactagagaagctcaaaaaagaacagcggctggaataatgaaaaatccaactgtcgacgggattgttgcaatagacttagatcccgtggtttacgatgcaaaatttgaaaaacaactaggccaaataatgttgttgatactttgcacatcacagattcttttgatgcggactacatgggccttgtgtgaatccatcacattggctactggacctctgaccactctttgggagggatctccaggaaaattctggaacaccacaatagcggtatccatggcaaacattttcagggggagttatctagcaggagcaggtctggccttctcattaatgaaatctctaggaggaggtaggagaggcacgggagcccaaggggaaacactgggagaaaaatggaaaagacaactaaaccaactgagcaagtcagaattcaatacttacaagaggagtgggattatggaggtggatagatccgaagccaaagagggactgaaaagaggagaaacaaccaaacacgcagtatcgagaggaacggccaaactgaggtggttcgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccaatcccaatggcgacctatggatggaacctagtaaagctgcactccggaaaagatgtattttttataccacctgagaaatgtgacacccttttgtgtgatattggtgagtcctctccgaacccaactatagaggaaggaagaacgttacgtgttctgaaaatggtggaaccatggctcagaggaaaccaattttgcataaaaattctaaatccctatatgccgagcgtggtagaaactctggaacaaatgcaaagaaaacatggaggaatgctagtgcgaaacccactctcaagaaattccacccatgaaatgtactgggtttcatgtggaacaggaaacattgtgtcagcagtaaacatgacatctagaatgttgctaaatcggttcacaatggctcacaggaagccaacatatgaaagagacgtggacttaggcgctggaacaagacatgtggcagtagaaccagaggtagccaacctagatatcattggccagaggatagagaatataaaaaatgaacataagtcaacatggcattatgatgaggacaatccatacaaaacatgggcctatcatggatcatatgaggttaagccatcaggatcggcctcatccatggtcaatggcgtggtgagattgctcaccaaaccatgggatgttatccccatggtcacacaaatagccatgactgataccacaccctttggacaacagagggtgtttaaagagaaagttgacacgcgcacaccaaaagcaaaacgtggcacagcacaaattatggaagtgacagccaggtggttatggggtttcctttctagaaacaaaaaacccagaatttgcacaagagaggagtttacaagaaaagttaggtcaaacgcagctattggagcagtgttcgttgatgaaaatcaatggaactcggcaaaagaagcagtggaagacgaacggttctgggaacttgtccacagagagagggagcttcataaacaggggaaatgtgccacgtgtgtctacaatatgatggggaagagagagaaaaaattaggagagttcggaaaggcaaaaggaagtcgtgcaatatggtacatgtggttgggagcacgcttcctagagtttgaagcccttggtttcatgaatgaagatcactggttcagtagagagaattcactcagtggagtggaaggagaaggactccacaaacttggatacatactcagagacatatcaaggattccaggggggaacatgtatgcagatgacacagccggatgggacacaagaataacagaggatgatctccagaatgaggctaaaatcactgacatcatggagcccgaacatgccctgctggctacgtcaatctttaagctgacctaccaaaataaggtggtaagggtgcagagaccagcaaaaaatggaaccgtgatggatgttatatccagacgtgaccagagaggcagtggacaggttggaacttatggcttaaacactttcaccaacatggaggcccaactgataagacaaatggagtccgagggaatctttttacccagcgaattggaaaccccaaatctagccggaagagttctcgactggttggaaaaatatggtgtcgaaaggctgaaaagaatggcaatcagcggagatgactgtgtggtgaaaccaattgatgacaggttcgcaacagccttaacagctttgaatgacatgggaaaagtaagaaaagacataccacaatgggaaccttcaaaaggatggaatgattggcaacaagtgcctttctgttcacaccacttccaccagctaattatgaaggatgggagggagatagtggtgccatgccgcaaccaagatgaacttgtggggagggccagagtatcacaaggcgccggatggagcctgagagaaaccgcatgcctaggcaagtcatatgcacaaatgtggcagctgatgtatttccacaggagagacctgagactggcggctaacgctatttgttcagccgttccagttgattgggtcccaaccagccgcaccacctggtcgatccatgcccatcaccaatggatgacaacagaagacatgttatcagtatggaatagggtctggatagaggaaaacccatggatggaggataagactcatgtgtccagttgggaagaagttccatacctaggaaagagggaagatcagtggtgtggatccctgataggcttaacagcaagggccacctgggccactaatatacaagtggccataaaccaagtgagaaggctcattgggaatgagaattatctagattacatgacatcaatgaagagattcaagaatgagagtgatcccgaaggggcactctggtaagtcaacacattcacaaaataaaggaaaataaaaaatcaaatgaggcaagaagtcaggccagattaagccatagtacggtaagagctatgctgcctgtgagccccgtccaaggacgtaaaatgaagtcaggccgaaagccacggtttgagcaagccgtgctgcctgtggctccatcgtggggatgtaaaaacccgggaggctgcaacccatggaagctgtacgcatggggtagcagactagtggttagaggagacccctcccaagacacaacgcagcagcggggcccaacaccaggggaagctgtaccctggtggtaaggactagaggttagaggagaccccccgcgtaacaataaacagcatattgacgctgggagagaccagagatcctgctgtctctacagcatcattccaggcacagaacgccagaaaatggaatggtgctgttgaatcaacaggttct

SEQ ID NO: 4 - protein, 3392 aa, Dengue virus type 1
MINQRKKTGRPSFNMLKRARNRVSTVSQLAKRFSKGLLSGQGPMKLVMAFIAFLRFLAIPPTAGILARWGSFKKNGAIKVLRGFKREISNMLNIMNRRKRSVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNTTFIIDGPNTPECPDNQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDFCEGTTVVVDEHCGNRGPSLRTTTVTGKIIHEWCCRSCTLPPLRFKGEDGCWYGMEIRPVKDKEENLVKSMVSAGSGEVDSFSLGLLCISIMIEEVMRSRWSKKMLMTGTLAVFLLLIMGQLTWSDLIRLCIMVGANASDKMGMGTTYLALMATFKMRPMFAVGLLFRRLTSREVLLLTIGLSLVASVELPSSLEELGDGLAIGIMMLKLLTDFQSHQLWATLLSLTFIKTTFSLHYAWKTMAMVLSIVSLFPLCLSTTSQKTTWLPVLLGSLGCKPLPMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGVPIRYQTTAVKSEHTGKEIVDLMCHATFTMRLLSPVRVPNYNMIIMDEAHFTDPASIAARGYISTRVGMGEAAAIFMTATPPGSVEAFPQSNAIIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALYEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLHPASAWTLYAVATTIITPMMRHTIENTTANISLTAIANQAAILMGLDKGWPISKMDIGVPLLALGCYSQVNPLTLIAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWELVHRERELHKQGKCATCVYNMMGKREKKLGEFGKAKGSRAIWYMWLGARFLEFEALGFMNEDHWFSRENSLSGVEGEGLHKLGYILRDISRIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 5 - DNA, 10723 bp, Dengue virus type 2
  CDS (97)..(10272)
agttgttagtctacgtggaccgacaaagacagattctttgagggagctaagctcaacgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagagggcatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgctcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgagcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgttcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcggaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 6 - protein, 3391 aa, Dengue virus type 2
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLLLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 7 - DNA, 10699 bp, Dengue virus type 3
  CDS (95)..(10267)
agttgttagtctacgtggaccgacaagaacagtttcgactcggaagcttgcttaacgtagtgctgacagttttttattagagagcagatctctgatgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcatttatagctttcctcagatttctagccattccaccgacagcaggagtcttggctagatggggtacctttaagaagtcgggggctattaaggtcttaaaaggcttcaagaaggagatctcaaacatgctgagcattatcaacaaacggaaaaagacatcgctctgtctcatgatgatgttaccagcaacacttgctttccacttaacttcacgagatggagagccgcgcatgattgtggggaagaatgaaagaggaaaatccctacttttcaagacagcctctggaatcaacatgtgcacactcatagccatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggaggatggacaaggaaaagctcacaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcagactcccccaagagactggcaacagccattgcaggcgcttgggaaaatggagtgtgcggaattaggtcaacaaccagaatggagaacctcttgtggaagcaaatagccaatgaactgaattacatattatgggaaaacaacattaaattaacggtagttgtaggcgacataactggggtcttagagcaagggaaaagaacactaacaccacaacccatggagctaaaatattcttggaaaacatggggaaaggcaaaaatagtgacagctgaaacacaaaattcctctttcataatagatgggccaagcacaccggagtgtccaagtgcctcaagagcatggaatgtgtgggaggtggaggattacgggttcggagttttcacaaccaacatatggctgaaactccgagaggtgtacacccaactatgtgaccataggctaatgtcggcagccgtcaaggatgagagggctgtacatgccgacatgggctattggatagaaagccaaaagaatgggagttggaagctagaaaaagcatccttcatagaggtgaaaacctgcacatggccaaaatcacacactctctggagcaatggtgtgctagagagtgacatgattatcccaaagagtctagctggtcccatttcgcaacacaaccacaggcccgggtaccacacccaaacggcaggaccctggcacttaggaaaattggagctggacttcaactattgtgaaggaacaacagttgtcatctcagaaaactgtgggacaagaggcccatcattgagaacaacaacggtgtcagggaagttgatacacgaatggtgctgccgctcgtgcacacttcctcccctacgatacatgggagaagacggctgctggtatggcatggaaatcagacccattaatgagaaagaagagaatatggtaaagtctctagcctcagcagggagtggaaaggtggacaacttcacaatgggtgtcttgtgtttggcaatcctctttgaagaggtgatgagaggaaaatttgggaaaaaacacatgattgcaggggttctcttcacgtttgtgctcctcctctcagggcaaataacatggagagacatggcgcacacactcataatgattgggtccaacgcctctgacagaatggggatgggcgtcacttacctagctctaattgcaacatttaaaattcagccattcctggctttgggattcttcctgaggaaactgacatctagagaaaatttattgctgggagttgggttggccatggcagcaacgttacgactgccagaggacattgaacagatggcgaatggaattgctttggggctcatggctcttaaactgataacacaatttgaaacataccaactatggacggcattagtttccctaacgtgttcaaatacaattttcacgttgactgttgcctggagaacagccactctgattttagccggaatttcgcttttgccagtgtgccagtcttcgagcatgaggaaaacagattggctcccaatgactgtggcagctatgggagctcaacccctaccactttttattttcagtctgaaagatacactcaaaaggagaagctggccactgaatgagggggtgatggcagttggacttgtgagcattctagctagttctctccttaggaatgatgtgcctatggctggaccattagtggctgggggcttgctgatagcgtgctacgtcataactggcacgtcagcagacctcactgtagaaaaagcagcagatgtaacatgggaggaagaggccgagcaaacaggagtgtcccacaatttaatggtcacagttgatgatgatggaacaatgagaataaaagatgacgagactgagaacatcttaacagtgcttttaaaaacagcactactaatagtatcaggcatctttccatactccatacccgcaacactgttggtctggcatacttggcaaaagcaaacccaaagatccggcgtcctatgggacgtacccagccccccagagacacagaaagcggaactggaagaaggggtctataggatcaaacagcaaggaatttttgggaaaacccaagtgggggttggagtacagaaagaaggagttttccacaccatgtggcatgtcacaagaggggcagtgttgacacacaatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcatttttcagacaacaacaggggaaataggagcaattgcactggatttcaagcctggaacttcaggatctcccatcataaacagagagggaaaggtagtgggactgtatggcaatggagtggttacaaagaatggaggctatgtcagtggaatagcgcaaacaaatgcagaaccagatggaccgacaccagagttggaagaagagatgttcaaaaagcgaaatctaaccataatggatctccatcctgggtcaggaaagacgcggaaatatcttccagctattgttagagaggcaatcaagagacgcttaaggactctaattttggcaccaacaagggtagttgcagctgagatggaagaagcattgaaagggctcccaataaggtatcaaacaactgcaacaaaatctgaacacacaggaagagagattgttgatctaatgtgtcacgcaacgttcacaatgcgcttgctgtcaccagtcagggttccaaactacaacttgataataatggatgaggcccatttcacagacccagccagtatagcggctagagggtacatatcaactcgtgtaggaatgggagaggcagccgcaattttcatgacagcaacaccccctggaacagctgatgcctttcctcagagcaacgctccaattcaagatgaagagagagacataccggaacgctcatggaattcaggcaatgaatggattactgactttgttgggaagacagtgtggtttgtccctagcatcaaagccggaaatgacatagcaaactgcttgcggaaaaatggaaaaaaggttattcaactcagcaggaagacctttgacacagaatatcaaaagaccaaactgaatgattgggactttgtggtgacaacagacatttcagaaatgggagccaatttcaaagcagatagagtgatcgacccaagaagatgtctcaagccggtgattttgacagatggacccgagcgggtgatcctggctggaccaatgccagtcaccgtagcgagcgctgcgcaaaggagagggagagttggcaggaacccacaaaaagaaaatgaccagtacatattcatgggccagcctctcaacaatgatgaagaccatgctcactggacagaagcaaaaatgctgctggacaacatcaacacaccagaagggattataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatatacagatagaaaatggtgctttgatggagaacgtaataatcaaattttagaggagaatatggatgtggaaatctggacaaaggaaggagaaaagaaaaaactgagacctaggtggcttgatgcccgcacttattcagatcctttagcactcaaagaattcaaggattttgcagctggcagaaagtcaatcgcccttgatcttgtgacagaaataggaagagtgccttcacacttagcccacagaacgagaaacgccctggataatttggtgatgctgcacacgtcagaacatggcggtagggcctacaggcatgcagtggaggaactaccagaaacgatggaaacactcttactcctgggactgatgatcttgttaacaggtggagcaatgctcttcttgatatcaggtaaagggattggaaagacttcaataggactcatttgtgtaattgcttccagcggcatgttatggatggctgatgtcccactccaatggatcgcatcggctatagtcctggagttttttatgatggtgttgctcataccagaaccagaaaagcagagaactccccaagacaaccaactcgcatatgtcgtgataggcatacttacattggctgcaatagtagcggccaatgaaatgggactgttggaaactacaaagagagatttaggaatgtctaaagaaccaggtgttgtttctccaaccagctatttggatgtggacttgcacccagcatcagcctggacattgtacgccgtggccacaacagtaataacaccaatgttgagacacaccatagagaattccacagcaaatgtgtctctggcagccatagctaaccaggcagtggtcctgatgggtttagacaaaggatggccgatatcgaaaatggacttgggcgtaccactattggcactgggttgctattcacaagtgaacccactaactcttgcagcggcagtacttttgctagtcacacattatgcaattataggtccaggattgcaggcaaaagccacccgtgaagctcagaaaaggacagctgctggaataatgaagaatccaacggtggatggaataatgacaatagacctagatcctgtaatatatgattcaaaatttgaaaagcaactaggacaggtcatgctcctggttctgtgtgcagtccaacttttattgatgagaacatcatgggccttgtgtgaagttctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtcattcctgaaggaagagtcatagacctaggctgtggaagaggaggctggtcatattactgtgcaggactgaaaaaagttacagaagtgcgaggatacacaaaaggcggcccaggacacgaagaaccagtacctatgtctacatacggatggaacatagtcaagttaatgagtggaaaggatgttttttatctgccacctgaaaagtgtgataccctattgtgtgacattggagaatcttcaccaagcccaacagtggaagaaagcagaaccataagagttttgaagatggttgaaccatggctaaagaacaaccagttttgcattaaagtattgaacccatacatgccaactgtgattgagcacttagaaagactacaaaggaaacatggaggaatgcttgtgagaaatccactctcacgaaactccacgcacgaaatgtattggatatccaatggtacaggcaatatcgtctcttcagtcaacatggtatccagattgctactgaacagattcacaatgacacacaggagacccaccatagagaaagatgtggatctaggagcaggaacccgacatgtcaatgcggaaccagaaacacccaacatggatgtcattggggaaagaataaaaaggatcaaagaggagcatagttcaacatggcactatgatgatgaaaatccttacaaaacgtgggcttaccatggatcctatgaagtaaaagccacaggctcagcctcctccatgataaatggagtcgtgaaactcctcacaaaaccatgggatgtggtgcccatggtgacacagatggcaatgacagatacaactccattcggccagcaaagagtttttaaagagaaagtggacaccaggacacctaggcccatgccaggaacaagaaaggttatggagatcacagcggagtggctttggaggaccctgggaaggaacaaaagacccagattatgcacaagggaggaattcacaaagaaggtcagaaccaacgcagctatgggcgctgtcttcacagaagagaaccaatgggacagtgcgagagctgctgttgaggacgaagaattttggaaacttgtggacagagaacgtgaactccacaaactgggcaagtgtggaagctgcgtttacaacatgatgggcaagagagagaaaaaacttggagagtttggtaaagcaaaaggcagtagggctatatggtacatgtggttgggagccaggtaccttgagttcgaggcgctcggattcctcaatgaagaccactggttctcgcgtgaaaactcttacagtggagtagaaggagaaggactgcacaagctgggatacatcttgagagatatttccaagatacccggaggagccatgtatgctgatgacacagccggttgggacacaagaataacagaagatgacctgcacaatgaggaaaaaatcacacagcagatggaccctgaacacaggcagctagcgaacgctatattcaagctcacataccaaaacaaagtggtcaaagtccaacgaccaactccaaagggcacggtaatggacatcatatctaggaaagaccaaagaggcagtggacaggtgggaacttatggtctgaacacattcaccaacatggaagcccagctaatcagacaaatggaaggagaaggcgtgttgtcaaaggcagacctcgagaacccccatccgctagagaagaaaattacacaatggttggaaactaaaggagtggaaaggttaaaaagaatggccatcagcggggatgattgcgttgtgaaaccaatcgacgacagattcgccaatgccctgcttgccctgaacgatatgggaaaggttagaaaggacatacctcaatggcagccatcaaagggatggcatgattggcaacaggtccccttctgctcccaccactttcatgaattgatcatgaaagatggaagaaagttggtagttccctgcagaccccaggacgaactaataggaagagcgagaatctcccaaggagcaggatggagccttagagaaactgcatgtctagggaaagcctacgctcaaatgtgggctctcatgtattttcacagaagagatcttagactagcatccaacgccatatgttcagcagtaccagtccactgggtccccacgagcagaacgacatggtctattcatgctcaccatcagtggatgactacagaagacatgcttactgtctggaacagggtgtggatagaggacaatccatggatggaagacaaaactccagtcacaacgtgggaagatgttccatatctagggaagagagaagaccaatggtgcggatcactcataggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaaaagcaggaggtaaactgtcaggccacattaagccacagtacggaagaagctgtgcagcctgtgagccccgtccaaggacgttaaaagaagaagtcaggcccaaaagccacggtttgagcaaaccgtgctgcctgtagctccgtcgtggggacgtaaagcctgggaggctgcaaaccgtggaagctgtacgcacggtgtagcagactagtggttagaggagacccctcccatgacacaacgcagcagcggggcccgagcactgagggaagctgtacctccttgcaaaggactagaggttagaggagaccccccgcaaacaaaaacagcatattgacgctgggagagaccagagatcctgctgtctcctcagcatcattccaggcacagaacgccagaaaatggaatggtgctgttgaatcaacaggttctagt

SEQ ID NO: 8 - protein, 3390 aa, Dengue virus type 3
MNNQRKKTGKPSINMLKRVRNRVSTGSQLAKRFSRGLLNGQGPMKLVMAFIAFLRFLAIPPTAGVLARWGTFKKSGAIKVLKGFKKEISNMLSIINKRKKTSLCLMMMLPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDITGVLEQGKRTLTPQPMELKYSWKTWGKAKIVTAETQNSSFIIDGPSTPECPSASRAWNVWEVEDYGFGVFTTNIWLKLREVYTQLCDHRLMSAAVKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVISENCGTRGPSLRTTTVSGKLIHEWCCRSCTLPPLRYMGEDGCWYGMEIRPINEKEENMVKSLASAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMAATLRLPEDIEQMANGIALGLMALKLITQFETYQLWTALVSLTCSNTIFTLTVAWRTATLILAGISLLPVCQSSSMRKTDWLPMTVAAMGAQPLPLFIFSLKDTLKRRSWPLNEGVMAVGLVSILASSLLRNDVPMAGPLVAGGLLIACYVITGTSADLTVEKAADVTWEEEAEQTGVSHNLMVTVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLAAAVLLLVTHYAIIGPGLQAKATREAQKRTAAGIMKNPTVDGIMTIDLDPVIYDSKFEKQLGQVMLLVLCAVQLLLMRTSWALCEVLTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHPLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 9 - DNA, 10648 bp, Dengue virus type 4
  CDS (102)..(10265)
agttgttagtctgtgtggaccgacaaggacagttccaaatcggaagcttgcttaacacagttctaacagtttgtttgaatagagagcagatctctggaaaaatgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaaaagatggggacagttgaagaaaaataaggccatcaggatactgattggattcaggaaggagataggccgcatgctgaacatcttgaacgggagaaaaaggtcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgcaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccggagtccccagcgagactagcgtctgcaatattgaatgcccacaaagatggggtctgtggaattagatcaaccacgaggctggaaaatgtcatgtggaagcaaataaccaacgagctaaattatgttctctgggaaggaggacatgacctcactgtagtggctggggatgtgaagggggtgttgaccaaaggcaagagagcactcacacccccagtgaatgatctgaaatattcatggaagacatggggaaaagcaaaaatcttcaccccagaagcaagaaatagcacatttttaatagacggaccagacacctccgaatgccccaatgaacgaagagcatggaactttcttgaggtggaagactatggatttggcatgttcacgaccaacatatggatgaaattccgagaaggaagttcagaagtgtgtgaccacaggttaatgtcagcggcaattaaagatcagaaagctgtgcatgctgacatgggttattggatagagagctcaaaaaaccagacctggcagatagagaaagcatctcttattgaagtgaaaacatgtctgtggcccaagacccacacattgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcgcaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtaacggccggacagggcacatcagaaactttttctatgggtctgttgtgcctgaccttgtttgtggaagaatgcttgaggagaagagtcactaggaaacacatgatattggttgtggtgatcactctttgtgccatcatcctaggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactggggctaattttgctaaaaatagtgacacattttgacaacacccaagtgggaaccttagccctttccttgaccttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttatttgggaaaactcaggttggagtagggatacacatggaaggtgtatttcacacaatgtggcatgtaacaagaggatcagtgatctgccatgagactgggagattggagccatcttgggctgacgtcaggaatgacatgatatcatacggtgggggatggagacttggagacaaatgggacaaagaagaagatgttcaggtcctcgccatagaaccaggaaaaaatcctaaacatgtccaaacgaaacccggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaaccttgattttggctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagagttccaaattacaacctcatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggattttgtggtcactacagacatatctgaaatgggggccaattttagagctgggagagtgatagaccctaggagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaaggaataaccaaattttagaagaaaacatggaggttgaaatttggactagagagggagaaaagaaaaagctaaggccaagatggttagatgcacgtgtatacgctgaccccatggctttgaaggattttaaggagtttgctagtggaaggaagagcataactctcgacatcctaacagagattgccagtttgccaacttacctttcctctagggccaagctcgcccttgataacatagtcatgctccacacaacagaaagaggagggagggcctaccaacacgccctgaacgaactcccggagtcactggaaacacttatgcttgtagctttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccattattggtctcatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcggccgtcctaatggggcttggaaaaggatggccgctccacagaatggacctcggtgtgccgctgttagcaatgggatgctattctcaagtgaacccaacaactttgacagcatccttagtcatgcttttagtccattatgcaataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaggtcatgctactcgtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacctggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagattagatggattgttgagagagggatggtaaagccaaaagggaaagttgtagatcttggctgtgggagaggaggatggtcttattacatggcgacgctcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaattattgggagaaggcttcagcgattgcaagaggagcacaaagaaacctggcattatgatcaggaaaacccatacagaacctgggcgtatcatggaagctatgaagctccttcgacaggctctgcatcctccatggtgaacggggtagtaaaactgctaacaaaaccttgggatgtggttccaatggtgacccagttagccatgacagacacaaccccttttgggcaacaaagagtgttcaaagagaaggtggataccagaacaccacaaccaaaacccggtacacgaatggttatgaccacgacagccaattggctgtgggccctccttgggaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaagaactgatcacggaacagatggccccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctggatgagaggtttggcacttccctcctcttcttgaacgacatgggaaaggtgaggaaagacattccgcagtgggaaccatctaagggatggaaaaactggcaagaggttcctttttgctcccaccactttcacaagatcttcatgaaggatggccgctcactagttgttccatgtagaaaccaggatgaactgatagggagagccagaatctcgcagggggctggatggagcttaagagaaacagcctgcctgggcaaagcttacgcccagatgtggtcgctcatgtacttccacagaagggatctgcgtttagcctccatggccatatgctcagcagttccaacggaatggtttccaacaagcagaacaacatggtcaatccacgctcatcatcagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcagaaacctgatcggaaaagaggaatacgtggattacatgccagtaatgaaaagatacagcgctccttcagagagtgaaggagttctgtaattaccaacaacaaacaccaaaggctattgaagtcaggccacttgtgccacggcttgagcaaaccgtgctgcctgtagctccgccaataatgggaggcgtgaaatccctagggaggccatgcgccacggaagctgtacgcgtggcatattggactagcggttagaggagacccctcccatcactgacaaaacgcagcaaaagggggcccgaagccaggaggaagctgtactcctggtggaaggactagaggttagaggagacccccccaacacaaaaacagcatattgacgctgggaaagaccagagatcctgctgtctctgcaacatcaatccaggcacagagcgaagcaagatggattggtgttgttgatccaacaggttct

SEQ ID NO: 10 - protein, 3387 aa, Dengue virus type 4
MNQRKKVVRPPFNMLKRERNRVSTPQGLVKRFSTGLFSGKGPLRMVLAFITFLRVLSIPPTAGILKRWGQLKKNKAIRILIGFRKEIGRMLNILNGRKRSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSATNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVAIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTHFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVVPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 11 - DNA, 10996 bp, Artificial Sequence
  West Nile/Dengue 1 virus chimera
  CDS (97)..(10365)
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagttcgaaacaaaagaaaagatccgtgaccatgctccttatgctgctgcccacagccctggcgttccatctgacgacacgagggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggttcctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagttggcatggtcacactgtacctaggagtcatggttcaggcagattccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 12 - protein, 3422 aa, Artificial Sequence
  Synthetic Construct
MSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRSVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAVGMVTLYLGVMVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 13 - DNA, 10996 bp, Artificial Sequence
  West Nile/Dengue 2 virus chimera with E203 Asn to Asp mutation
  CDS (97)..(10365)
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagctcaaaacaaaagaaaagatccgcgggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgttgcagatggaagataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgattccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 14 - protein, 3422 aa, Artificial Sequence
  Synthetic Construct
MSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 15 - DNA, 11002 bp, Artificial Sequence
  WN/DEN3 chimera with E345 His to Leu mutation (BE345)
  CDS (97)..(10371)
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagttcgaaacaaaagaaaagaggaggaaagaccggaattctctgtctcatgatgatgttaccagcaacacttgctttccacttaacttcacgagatggagagccgcgcatgattgtggggaagaatgaaagaggaaaatccctacttttcaagacagcctctggaatcaacatgtgcacactcatagccatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggaggatggacaaggaaaagctctcaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattacactctatctgggagccgtggtgcaagctgactccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 16 - protein, 3424 aa, Artificial Sequence
  Synthetic Construct
MSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGKTGILCLMMMLPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKALNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAIGIITLYLGAVVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 17 - DNA, 11002 bp, Artificial Sequence
  WN/DEN3 chimera with E345 His to Leu mutation (CE345)
  CDS (97)..(10371)
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagttcgaaacaaaagaaaagaggaggaaagaccggaattgcagtcatgattggcctgatcgccagcgtaggagctttccacttaacttcacgagatggagagccgcgcatgattgtggggaagaatgaaagaggaaaatccctacttttcaagacagcctctggaatcaacatgtgcacactcatagccatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggaggatggacaaggaaaagctctcaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattacactctatctgggagccgtggtgcaagctgactccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 18 - protein, 3424 aa, Artificial Sequence
  Synthetic Construct
MSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGKTGIAVMIGLIASVGAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKALNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAIGIITLYLGAVVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 19 - DNA, 10996 bp, Artificial Sequence
  WN/DEN4 chimera with C107 Thr to Pro mutation
  CDS (97)..(10365)
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagctcaaaacaaaagaaaaggtcaccgataacattgctgtgcttgattcccaccgtaatggcgtttcacttgtcaacaagagatggcgaacccctcatgatagtggcaaaacatgaaagggggagacctctcctgtttaagacaacagaggggatcaacaaatgcactctcattgccatggacttgggtgaaatgtgtgaggacactgtcacgtacaaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtagggaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgcaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggctatgacgtgcatagctgttggaggaatcactctgtttctgggcttcacagttcaagcagactccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 20 - protein, 3422 aa, Artificial Sequence
  Synthetic Construct
MSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRSPITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSATNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 21 - protein, 18 aa, Artificial Sequence
  C protein signal sequence of WN/DEN1 chimera with Type II junction
GGKTGITMLLMLLPTALA

SEQ ID NO: 22 - protein, 18 aa, Artificial Sequence
  C protein signal sequence of WN/DEN2 chimera with Type II junction
GGKTGIGMIIMLIPTVMA

SEQ ID NO: 23 - protein, 18 aa, Artificial Sequence
  C protein signal sequence of WN/DEN4 chimera with Type II junction
GGKTGIITLLCLIPTVMA

I claim:

1. A nucleic acid chimera comprising:
   a first nucleic acid molecule comprising a 5' non-coding region, a nucleic acid encoding non-structural proteins and a C protein, and a 3' non-coding region from a West Nile virus genome, wherein the C protein comprises a signal sequence 18 amino acids long comprising a 5' portion of a prM signal sequence from the West Nile virus genome and a 3' portion of a prM signal sequence from a Dengue virus genome; and
   a second nucleic acid molecule operably linked to the first nucleic acid molecule, encoding at least a portion of a prM protein and E protein from a Dengue virus genome, wherein the second nucleic acid is 3' to the portion of the prM signal sequence from the Dengue virus genome and 5' to the non-structural proteins and 3' non-coding region from the West Nile virus.

2. The nucleic acid chimera of claim 1, wherein the 5' portion of the prM signal sequence from the West Nile virus genome comprises the first six amino acids of the West Nile virus prM signal sequence and the 3' portion of the prM signal sequence from the Dengue virus genome comprises the last twelve amino acids of the Dengue virus prM signal sequence.

3. The nucleic acid chimera of claim 2, wherein the first six amino acids of the West Nile virus prM signal sequence comprise GGKTGI (amino acids 106-111 of SEQ ID NO: 2).

4. The nucleic acid chimera of claim 2, wherein the last twelve amino acids of the Dengue virus prM signal sequence comprise amino acids 103-114 of any one of SEQ ID NOs: 4, 6, or 8, or amino acids 102-113 of SEQ ID NO: 10.

5. The nucleic acid chimera of claim 1, wherein the E protein comprises an amino acid substitution at an amino acid corresponding to E protein amino acid 347 of DEN1, DEN2, or DEN4, corresponding to amino acid position 627 of SEQ ID NO: 4 or SEQ ID NO: 6, or amino acid position 626 of SEQ ID NO: 10, or E protein amino acid 345 of DEN3, corresponding to amino acid position 625 of SEQ ID NO: 8.

6. The nucleic acid chimera of claim 5, wherein the amino acid substitution comprises a histidine to leucine substitution in DEN3, a glutamine to leucine substitution in DEN1, or a valine to leucine substitution in DEN2 or DEN4.

7. The nucleic acid chimera of claim 1, comprising comprising the nucleic acid sequence of SEQ ID NO: 15.

8. The nucleic acid chimera of claim 1, wherein the nucleic acid chimera encodes the amino acid sequence of SEQ ID NO: 16.

9. A nucleic acid chimera comprising:
a first nucleic acid molecule comprising a 5' non-coding region, a nucleic acid encoding non-structural proteins and a C protein, and a 3' non-coding region from a West Nile virus genome; and
a second nucleic acid molecule operably linked to the first nucleic acid molecule, encoding at least a portion of a prM protein and E protein from a Dengue virus genome, wherein the second nucleic acid is 3' to the C protein from the West Nile virus genome and 5' to the non-structural proteins and 3' non-coding region from the West Nile virus genome and wherein the E protein comprises an amino acid substitution at an amino acid corresponding to E protein amino acid position 347 of DEN1, DEN2, or DEN4, corresponding to amino acid position 627 of SEQ ID NO: 4 or SEQ ID NO: 6, or amino acid position 626 of SEQ ID NO: 10 or E protein amino acid position 345 of DEN3, corresponding to amino acid position 625 of SEQ ID NO: 8.

10. The nucleic acid chimera of claim 9, comprising the nucleic acid sequence of SEQ ID NO: 17.

11. The nucleic acid chimera of claim 10, wherein the nucleic acid chimera encodes an amino acid sequence comprising SEQ ID NO: 18.

12. A nucleic acid chimera comprising:
a first nucleic acid molecule comprising a 5' non-coding region, a nucleic acid encoding non-structural proteins and a C protein, and a 3' non-coding region from a West Nile virus genome, wherein the C protein comprises a prM signal sequence from a Dengue virus genome; and
a second nucleic acid molecule operably linked to the first nucleic acid molecule encoding a prM protein and an E protein from the Dengue virus genome, wherein the second nucleic acid is 3' to the prM signal sequence from the Dengue virus genome and 5' to the non-structural proteins and 3' non-coding region from the West Nile virus;
wherein:
the C protein comprises an amino acid substitution at one or more of an amino acid corresponding to amino acid position 92 of WNV, corresponding to amino acid position 92 of SEQ ID NO: 2; amino acid position 101 of DEN1, DEN2, or DEN3, corresponding to amino acid position 101 of any one of SEQ ID NOs: 4, 6, or 8; amino acid position 100 of DEN4 corresponding to amino acid position 100 of SEQ ID NO: 10; amino acid position 102 of DEN1, DEN2, or DEN3, corresponding to amino acid position 102 of any one of SEQ ID NOs: 4, 6, or 8; or amino acid position 101 of DEN4, corresponding to amino acid position 101 of SEQ ID NO: 10;
the prM protein comprises an amino acid substitution at one or more of an amino acid corresponding to amino acid position 22 of DEN1, DEN2, DEN3, corresponding to amino acid position 136 of SEQ ID NOs: 4, 6, 8; amino acid position 135 of DEN1, DEN2, DEN3, or DEN4, corresponding to amino acid position 249 of SEQ ID NOs: 4, 6, 8 or amino acid position 248 of SEQ ID NO: 10; amino acid position 154 of DEN1, DEN2, DEN3, or DEN4, corresponding to amino acid position 268 of SEQ ID NOs: 4, 6, 8 or amino acid position 267 of SEQ ID NO: 10; or amino acid position 155 of DEN1, DEN2, DEN3, or DEN4, corresponding to amino acid position 269 of SEQ ID NOs: 4, 6, 8 or amino acid position 268 of SEQ ID NO: 10;
the E protein comprises an amino acid substitution at one or more of an amino acid corresponding to amino acid position 171 of DEN1, DEN2, DEN3, or DEN4, corresponding to amino acid 451 of SEQ ID NOs: 4, 6, or 8 or amino acid position 450 of SEQ ID NO: 10; amino acid position 311 of DEN1, DEN2 or DEN4, corresponding to amino acid position of 591 of SEQ ID NO: 4 or 6 or amino acid position 590 of SEQ ID NO: 10; amino acid position 309 of DEN3, corresponding to amino acid position 589 of SEQ ID NO: 8; amino acid position 347 of DEN1, DEN2, or DEN4, corresponding to amino acid position 627 of SEQ ID NO: 4 or SEQ ID NO: 6, or amino acid position 626 of SEQ ID NO: 10; amino acid position 345 of DEN3, corresponding to amino acid position 625 of SEQ ID NO: 8; amino acid position 397 of DEN1, DEN2, or DEN4, corresponding to amino acid position 677 of SEQ ID NO: 4 or 6 or amino acid position 676 of SEQ ID NO: 10; amino acid position 395 of DEN3, corresponding to amino acid position 675 of SEQ ID NO: 8; amino acid position 417 of DEN1, DEN2, or DEN4, corresponding to amino acid position 697 of SEQ ID NO: 4 or 6 or amino acid position 696 of SEQ ID NO: 10; or amino acid position 415 of DEN3, corresponding to amino acid position 695 of SEQ ID NO: 8;
the NS3 protein comprises a substitution at amino acid position 71 of WNV, corresponding to amino acid position 1576 of SEQ ID NO: 2; and/or
the NS4A protein comprises a substitution at amino acid position 18 of WNV, corresponding to amino acid position 2142 of SEQ ID NO: 2.

13. The nucleic acid chimera of claim 12, comprising the nucleic acid sequence of SEQ ID NO: 19.

14. The nucleic acid chimera of claim 12, wherein the nucleic acid chimera encodes the amino acid sequence comprising SEQ ID NO: 20.

15. An immunogenic composition comprising one or more inactivated viruses comprising the nucleic acid chimera of claim 12 and a pharmaceutically acceptable carrier.

16. The immunogenic composition of claim 15, further comprising:
(i) an inactivated virus comprising a WN/DEN2 nucleic acid chimera comprising:
a first nucleic acid molecule comprising a 5' non-coding region, a nucleic acid encoding non-structural proteins and a C protein, and a 3' non-coding region from a West Nile virus genome, wherein the C protein comprises a prM signal sequence from a Dengue-2 virus genome; and a second nucleic acid molecule operably linked to the first nucleic acid molecule encoding a prM protein and an E protein from the Dengue-2 virus genome, wherein the E protein comprises an amino acid substitution at position 203, corresponding to amino acid position 483 of SEQ ID NO: 6; and/or (ii) an inactivated virus comprising a WN/DEN1 nucleic acid chimera comprising:

a first nucleic acid molecule comprising a 5' non-coding region, a nucleic acid encoding non-structural proteins and a C protein, and a 3' non-coding region from a West Nile virus genome, wherein the C protein comprises a prM signal sequence from a Dengue-1 virus genome; and a second nucleic acid molecule operably linked to the first nucleic acid molecule encoding a prM protein and an E protein from the Dengue-1 virus genome.

17. The immunogenic composition of claim 16, wherein the amino acid substitution at E protein position 203 of the WN/DEN2 chimera comprises an asparagine to aspartic acid substitution.

18. The immunogenic composition of claim 16, wherein the WN/DEN2 chimera comprises the nucleic acid sequence of SEQ ID NO: 13.

19. The immunogenic composition of claim 16, wherein the WN/DEN2 chimera encodes an amino acid sequence comprising SEQ ID NO: 14.

20. The immunogenic composition of claim 16, wherein the WN/DEN1 chimera comprises the nucleic acid sequence of SEQ ID NO: 11.

21. The immunogenic composition of claim 20, wherein the WN/DEN1 chimera encodes an amino acid sequence comprising SEQ ID NO: 12.

22. The immunogenic composition of claim 15, wherein the composition comprises a virus comprising a WN/DEN1 nucleic acid chimera, a virus comprising a WN/DEN2 nucleic acid chimera, a virus comprising a WN/DEN3 nucleic acid chimera, and a virus comprising a WN/DEN4 nucleic acid chimera.

23. An immunogenic composition comprising one or more inactivated WN/DENV chimeric viruses comprising a nucleic acid sequence comprising SEQ ID NOs: 11, 13, 17, 15, or 19 and a pharmaceutically acceptable carrier.

24. The immunogenic composition of claim 15, further comprising one or more adjuvants.

25. The immunogenic composition of claim 15, wherein the one or more inactivated viruses are purified and/or wherein the one or more inactivated viruses are inactivated by one or more of chemical treatment, physical treatment, and irradiation.

26. A method of eliciting an immune response against one or more Dengue viruses in a subject comprising administering the immunogenic composition of claim 15 to the subject.

27. The method of claim 26, wherein the immune response comprises an immune response to each of DEN1, DEN2, DEN3, and DEN4.

28. The method of claim 26, comprising administering one to five doses of the immunogenic composition to the subject.

29. The method of claim 26, further comprising administering one or more adjuvants to the subject.

* * * * *